(12) United States Patent
Schellenberger et al.

(10) Patent No.: US 9,249,211 B2
(45) Date of Patent: *Feb. 2, 2016

(54) BINDING FUSION PROTEINS, BINDING FUSION PROTEIN-DRUG CONJUGATES, XTEN-DRUG CONJUGATES AND METHODS OF MAKING AND USING SAME

(71) Applicant: Amunix Operating Inc., Mountain View, CA (US)

(72) Inventors: Volker Schellenberger, Palo Alto, CA (US); Joshua Silverman, Sunnyvale, CA (US); Chia-wei Wang, Milpitas, CA (US); Benjamin Spink, San Carlos, CA (US); Willem P. Stemmer, Los Gatos, CA (US); Nathan Geething, San Juan, PR (US)

(73) Assignee: Amunix Operating Inc., Mountain View, CA (US)

( * ) Notice: Subject to any disclaimer, the term of this patent is extended or adjusted under 35 U.S.C. 154(b) by 0 days.

This patent is subject to a terminal disclaimer.

(21) Appl. No.: 13/631,361

(22) Filed: Sep. 28, 2012

(65) Prior Publication Data
US 2013/0165389 A1     Jun. 27, 2013

Related U.S. Application Data

(63) Continuation of application No. PCT/US2011/030992, filed on Apr. 1, 2011.

(60) Provisional application No. 61/341,720, filed on Apr. 2, 2010, provisional application No. 61/341,996, filed on Apr. 8, 2010.

(51) Int. Cl.
*C07K 14/00* (2006.01)
*C07K 14/81* (2006.01)
(Continued)

(52) U.S. Cl.
CPC .............. *C07K 14/8125* (2013.01); *C07K 14/00* (2013.01); *C07K 16/18* (2013.01); *C07K 16/241* (2013.01); *C07K 16/244* (2013.01); *C07K 16/40* (2013.01); *A61K 38/00* (2013.01)

(58) Field of Classification Search
CPC .... A61K 38/00; C07K 14/00; C07K 14/8125; C07K 16/18; C07K 16/241; C07K 16/244; C07K 16/40
See application file for complete search history.

(56) References Cited

U.S. PATENT DOCUMENTS

| 5,270,176 A | 12/1993 | Dorschug et al. |
| 5,599,907 A | 2/1997 | Anderson et al. |

(Continued)

FOREIGN PATENT DOCUMENTS

| WO | WO 97/33552 A1 | 9/1997 |
| WO | WO 99/49901 A1 | 10/1999 |

(Continued)

OTHER PUBLICATIONS

Scholle et al., A recombinant polypeptide extends the in vivo half-life of peptides and proteins in a tunable manner, Nature Biotechnology, vol. 27:1186-1190 (Nov. 15, 2009).*

(Continued)

*Primary Examiner* — James H Alstrum Acevedo
*Assistant Examiner* — Randall L Beane
(74) *Attorney, Agent, or Firm* — Wilson Sonsini Goodrich & Rosati

(57) ABSTRACT

The present invention relates to binding fusion protein compositions comprising targeting moieties linked to extended recombinant polypeptide (XTEN), binding fusion protein-drug conjugate compositions, and XTEN-drug conjugate compositions, isolated nucleic acids encoding the compositions and vectors and host cells containing the same, and methods of using such compositions in treatment of diseases, disorders, and conditions.

19 Claims, 51 Drawing Sheets

(51) Int. Cl.
  *C07K 16/24* (2006.01)
  *C07K 16/40* (2006.01)
  *C07K 16/18* (2006.01)
  *A61K 38/00* (2006.01)

(56) References Cited

U.S. PATENT DOCUMENTS

| | | | |
|---|---|---|---|
| 7,442,778 | B2 | 10/2008 | Gegg et al. |
| 7,452,967 | B2 | 11/2008 | Bertin |
| 7,528,242 | B2 | 5/2009 | Anderson et al. |
| 7,846,455 | B2 | 12/2010 | Collins et al. |
| 8,557,961 | B2 * | 10/2013 | Silverman et al. ............ 530/350 |
| 8,673,860 | B2 * | 3/2014 | Schellenberger et al. ... 514/21.2 |
| 8,680,050 | B2 * | 3/2014 | Schellenberger et al. ..... 514/5.1 |
| 8,703,717 | B2 * | 4/2014 | Schellenberger et al. ... 514/21.2 |
| 8,716,448 | B2 * | 5/2014 | Schellenberger et al. .... 530/384 |
| 2003/0049689 | A1 | 3/2003 | Edwards et al. |
| 2003/0181381 | A1 | 9/2003 | Himmelspach et al. |
| 2003/0190740 | A1 | 10/2003 | Altman |
| 2004/0043446 | A1 | 3/2004 | DeFrees et al. |
| 2004/0259775 | A1 | 12/2004 | Kyle |
| 2004/0259780 | A1 | 12/2004 | Glasebrook et al. |
| 2005/0042721 | A1 | 2/2005 | Fang et al. |
| 2005/0118136 | A1 | 6/2005 | Leung et al. |
| 2005/0123997 | A1 | 6/2005 | Lollar |
| 2005/0287153 | A1 | 12/2005 | Dennis |
| 2006/0026719 | A1 | 2/2006 | Kieliszewski et al. |
| 2006/0287220 | A1 | 12/2006 | Li et al. |
| 2006/0293232 | A1 | 12/2006 | Levy et al. |
| 2007/0048282 | A1 | 3/2007 | Rosen et al. |
| 2007/0161087 | A1 | 7/2007 | Glaesner et al. |
| 2007/0203058 | A1 | 8/2007 | Lau et al. |
| 2007/0244301 | A1 | 10/2007 | Siekmann et al. |
| 2008/0039341 | A1 | 2/2008 | Schellenberger et al. |
| 2008/0167238 | A1 | 7/2008 | Rosen et al. |
| 2008/0176288 | A1 | 7/2008 | Leung et al. |
| 2008/0286808 | A1 | 11/2008 | Schellenberger et al. |
| 2008/0312157 | A1 | 12/2008 | Levy et al. |
| 2009/0060862 | A1 | 3/2009 | Chang et al. |
| 2009/0092582 | A1 | 4/2009 | Bogin et al. |
| 2009/0155275 | A1 | 6/2009 | Wu et al. |
| 2010/0189682 | A1 | 7/2010 | Schellenberger et al. |
| 2010/0239554 | A1 | 9/2010 | Schellenberger et al. |
| 2010/0292130 | A1 | 11/2010 | Skerra et al. |
| 2011/0151433 | A1 | 6/2011 | Schellenberger et al. |

FOREIGN PATENT DOCUMENTS

| | | |
|---|---|---|
| WO | WO 2005/025499 A2 | 3/2005 |
| WO | WO 2005/025499 A3 | 5/2005 |
| WO | WO 2006/081249 A2 | 8/2006 |
| WO | WO 2006/081249 A3 | 2/2007 |
| WO | WO 2007/103455 A2 | 9/2007 |
| WO | WO 2007/103455 A3 | 11/2007 |
| WO | WO 2008/049931 A1 | 5/2008 |
| WO | WO 2008/155134 A1 | 12/2008 |
| WO | WO 2009023270 A2 * | 2/2009 |
| WO | WO 2010/091122 A1 | 8/2010 |
| WO | WO 2010/144502 A2 | 12/2010 |
| WO | WO 2010/144508 A1 | 12/2010 |
| WO | WO 2011/028228 A1 | 3/2011 |
| WO | WO 2011/028229 A1 | 3/2011 |
| WO | WO 2011/084808 A2 | 7/2011 |
| WO | WO 2011/123813 A2 | 10/2011 |

OTHER PUBLICATIONS

Bailon, et al. Rational design of a potent, long-lasting form of interferon: a 40 kDa branched polyethylene glycol-conjugated interferon alpha-2a for the treatment of hepatitis C. Bioconjug Chem. Mar.-Apr. 2001;12(2):195-202.

Geething, et al. Gcg-XTEN: an improved glucagon capable of preventing hypoglycemia without increasing baseline blood glucose. PLoS One. Apr. 14, 2010;5(4):e10175. doi: 10.1371/journal.pone. 0010175.

Kyngas, et al. Unreliability of the Chou-Fasman parameters in predicting protein secondary structure. Protein Eng. May 1998;11(5):345-8.

Schlapschy, et al. Fusion of a recombinant antibody fragment with a homo-amino-acid polymer: effects on biophysical properties and prolonged plasma half-life. Protein Eng Des Sel. Jun. 2007;20(6):273-84. Epub Jun. 26, 2007.

Altschul et al. Basic Local Alignment Search Tool. J. Mol. Biol. 1990; 215:403-410.

Alvarez, et al. Improving Protein Pharmacokinetics by Genetic Fusion to Simple Amino Acid Sequences. J Biol Chem. 2004; 279: 3375-81.

Arndt, et al. Factors influencing the dimer to monomer transition of an antibody single-chain Fv fragment. Biochemistry. 1998; 37(37):12918-26.

Ausubel, et al. eds. Current Protocols in Molecular Biology. Wiley. 1987.

Buscaglia, et al. Tandem amino acid repeats from Trypanosoma cruzi shed antigens increase the half-life of proteins in blood. Blood. Mar. 15, 1999;93(6):2025-32.

Chou, et al. Prediction of Protein Conformation. Biochemistry. 1974; 13: 222-245.

Collen, et al. Polyethylene Glycol—Derivatized Cysteine-Substitution Variants of Recombinant Staphylokinase for Single-Bolus Treatment of Acute Myocardial Infarction. Circulation. 2000; 102: 1766-72.

D'Aquino, et al. The magnitude of the backbone conformational entropy change in protein folding. Proteins. 1996; 25: 143-56.

Deckert, et al. Pharmacokinetics and microdistribution of polyethylene glycol-modified humanized A33 antibody targeting colon cancer xenografts. Int J Cancer. 2000; 87: 382-90.

Dhalluin, et al. Structural and biophysical characterization of the 40 kDa PEG-interferon-alpha2a and its individual positional isomers. Bioconjug Chem. 2005; 16: 504-17.

Ellis, et al. Valid and invalid implementations of GOR secondary structure predictions. Comput Appl Biosci. Jun. 1994;10(3):341-8. (Abstract only).

Gustafsson, et al. Codon bias and heterologous protein expression. Trends Biotechnol. 2004; 22: 346-53.

Hopp, et al. Prediction of protein antigenic determinants from amino acid sequences. Proc Natl Acad Sci U S A 1981; 78, 3824, #3232.

International search report and written opinion dated Dec. 20, 2010 for PCT Application No. US10/02147.

International search report dated Jul. 12, 2011 for PCT Application No. US20/61590.

International search report dated Oct. 4, 2011 for PCT Application No. US2011/30992.

International search report dated Dec. 26, 2007 for PCT Application No. US2007/05952.

International search report dated Mar. 16, 2009 for PCT Application No. US2008/09787.

International search report dated Apr. 20, 2010 for PCT Application No. US10-23106.

Kochendoerfer. Chemical and biological properties of polymer-modified proteins. Expert Opin Biol Ther. 2003; 3: 1253-61.

Kohn, et al. Random-coil behavior and the dimensions of chemically unfolded proteins. Proc Natl Acad Sci U S A. Aug. 24, 2004;101(34):12491-6.

Kornblatt, et al. Cross-linking of cytochrome oxidase subunits with difluorodinitrobenzene. Can J. Biochem. 1980; 58: 219-224.

Kubetzko, et al. Protein PEGylation decreases observed target association rates via a dual blocking mechanism. Mol Pharmacol. 2005; 68: 1439-54.

Levitt. A simplified representation of protein conformations for rapid simulation of protein folding. J Mol Biol 1976; 104, 59-107.

McPherson, et al. eds. PCR 2: a practical approach. Oxford University Press. 1995.

Mitraki, et al. Protein Folding Intermediates and Inclusion Body Formation. Bio/Technology. 1989; 7:690-697.

Oslo, ed. Remington's Pharmaceutical Sciences. 16th edition. 1980.

(56) References Cited

OTHER PUBLICATIONS

Pepinsky, et al. Improved pharmacokinetic properties of a polyethylene glycol-modified form of interferon-beta-1a with preserved in vitro bioactivity. J Pharmacol Exp Ther. 2001; 297: 1059-66.

Sambrook, et al. Molecular Cloning: A Laboratory Manual, 2nd Edition; Current Protocols In Molecular Biology. 1989.

Singh, et al. ProPred: Prediction of HLA-DR binding sites. Bioinformatics. 2001; 17: 1236-1237.

Smith, et al. Single-step purification of polypeptides expressed in *Escherichia coli* as fusions with glutathione S-transferase. Gene. 1988; 67(1):31-40.

Stickler, et al. Human population-based identification of CD4(+) T-cell peptide epitope determinants. J Immunol Methods. 2003; 281: 95-108.

Stites, et al. Empirical evaluation of the influence of side chains on the conformational entropy of the polypeptide backbone. Proteins. 1995; 22: 132-140.

Sturniolo, et al. Generation of tissue-specific and promiscuous HLA ligand databases using DNA microarrays and virtual HLA class II matrices. Natural Biotechnol. 1999; 17: 555-561.

Uversky, et al. Why are "natively unfolded" proteins unstructured under physiologic conditions? Proteins. Nov. 15, 2000;41(3):415-27.

Venkatachalam, et al. Conformation of polypeptide chains. Annu Rev Biochem. 1969; 38: 45-82.

Walker, et al. Using protein-based motifs to stabilize peptides. J Pept Res. Nov. 2003;62(5):214-26.

Wright, et al. Intrinsically unstructured proteins: re-assessing the protein structure-function paradigm. J Mol Biol. Oct. 22, 1999;293(2):321-31.

Yankai, et al. Ten tandem repeats of beta-hCG 109-118 enhance immunogenicity and anti-tumor effects of beta-hCG C-terminal peptide carried by mycobacterial heat-shock protein HSP65. Biochem Biophys Res Commun. 2006; 345(4):1365-71.

European search report and search opinion dated Sep. 5, 2014 for EP Application No. 11763532.6.

* cited by examiner

| LCW0569 | ATGGCTNNNNNNGCTGGCTCTCCAACCTCCACTGAGGAAGGT |
|---------|--------------------------------------------|
|         | M   A   X   X   A   G   S   P   T   S   T   E   E |
| LCW0570 | ATGGCTNNNNNNGAAAGCGCAACCCCTGAGTCCGGTCCAGGT |
|         | M   A   X   X   E   S   A   T   P   E   S   G   P |
| LCW0571 | ATGGCTNNNNNNACTCCGTCTGGTGCTACCGGTTCCCCAGGT |
|         | M   A   X   T   P   S   G   A   T   G   S   P |

```
X = APST,       GS          or   GE
    TCAG/C/TCAG, AG/G/TC    or   G/AG/AG
    Diversity: 16     4              4
```

- Batch 2 libraries are based on 3 best clones from batch 1 screening.
- All 24 codons for 6 amino acids G,E,S,P,A,T are included.
- Each new library is composed of 3x3=9 pairs of annealed oligos.

FIG. 12

FIG. 20A  FIG. 20B
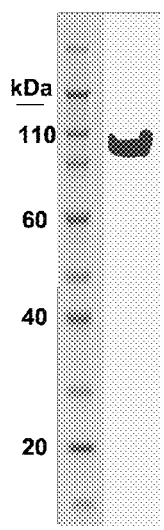
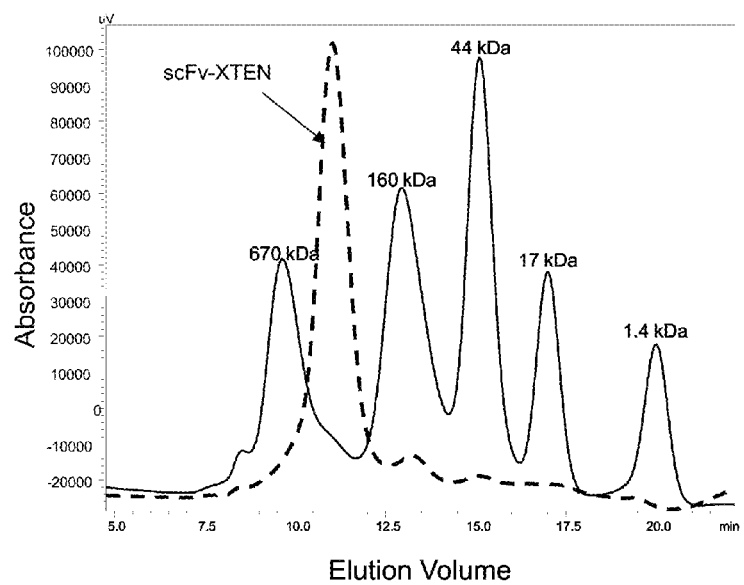

AG864

GASPGTSSTGSPGSSPSASTGTGPGSSPSASTGTGPGTPGSGTASSSPGSSTPSGATGSPGSSPSASTGTG
PGASPGTSSTGSPGTPGSGTASSSPGSSTPSGATGSPGTPGSGTASSSPGASPGTSSTGSPGASPGTSSTG
SPGTPGSGTASSSPGSSTPSGATGSPGASPGTSSTGSPGTPGSGTASSSPGSSTPSGATGSPGSSPSASTG
TGPGSSPSASTGTGPGSSTPSGATGSPGSSTPSGATGSPGASPGTSSTGSPGASPGTSSTGSPGASPGTSS
TGSPGTPGSGTASSSPGASPGTSSTGSPGASPGTSSTGSPGASPGTSSTGSPGSSPSASTGTGPGTPGSGT
ASSSPGASPGTSSTGSPGASPGTSSTGSPGASPGTSSTGSPGSSTPSGATGSPGSSTPSGATGSPGASPGT
SSTGSPGTPGSGTASSSPGSSTPSGATGSPGSSTPSGATGSPGSSTPSGATGSPGSSPSASTGTGPGASPG
TSSTGSPGASPGTSSTGSPGTPGSGTASSSPGASPGTSSTGSPGASPGTSSTGSPGASPGTSSTGSPGASP
GTSSTGSPGTPGSGTASSSPGSSTPSGATGSPGTPGSGTASSSPGSSTPSGATGSPGTPGSGTASSSPGSS
TPSGATGSPGSSTPSGATGSPGSSPSASTGTGPGSSPSASTGTGPGASPGTSSTGSPGTPGSGTASSSPGS
STPSGATGSPGSSPSASTGTGPGSSPSASTGTGPGASPGTSSTGSPGASPGTSSTGSPGSSTPSGATGSPG
SSPSASTGTGPGASPGTSSTGSPGSSPSASTGTGPGTPGSGTASSSPGSSTPSGATGSPGSSTPSGATGSP
GASPGTSSTGSP

AG576

PGTPGSGTASSSPGSSTPSGATGSPGSSPSASTGTGPGSSPSASTGTGPGSSTPSGATGSPGSSTPSGATG
SPGASPGTSSTGSPGASPGTSSTGSPGASPGTSSTGSPGTPGSGTASSSPGASPGTSSTGSPGASPGTSST
GSPGASPGTSSTGSPGSSPSASTGTGPGTPGSGTASSSPGASPGTSSTGSPGASPGTSSTGSPGASPGTSS
TGSPGSSTPSGATGSPGSSTPSGATGSPGASPGTSSTGSPGTPGSGTASSSPGSSTPSGATGSPGSSTPSG
ATGSPGSSTPSGATGSPGSSPSASTGTGPGASPGTSSTGSPGASPGTSSTGSPGTPGSGTASSSPGASPGT
SSTGSPGASPGTSSTGSPGASPGTSSTGSPGASPGTSSTGSPGTPGSGTASSSPGSSTPSGATGSPGTPGS
GTASSSPGSSTPSGATGSPGTPGSGTASSSPGSSTPSGATGSPGSSTPSGATGSPGSSPSASTGTGPGSSP
SASTGTGPGASPGTSSTGSPGTPGSGTASSSPGSSTPSGATGSPGSSPSASTGTGPGSSPSASTGTGPGAS
PGTSSTGS

GASPGTSSTGSPGSSPSASTGTGPGSSPSASTGTGPGTPGSGTASSSPGSSTPSGATGSPGSSPSASTGTG
PGASPGTSSTGSPGTPGSGTASSSPGSSTPSGATGSPGTPGSGTASSSPGASPGTSSTGSPGASPGTSSTG
SPGTPGSGTASSSPGSSTPSGATGSPGASPGTSSTGSPGTPGSGTASSSPGSSTPSGATGSPGSSPSASTG
TGPGSSPSASTGTGPGSSTPSGATGSPGSSTPSGATGSPGASPGTSSTGSPGASPGTSSTGSPGASPGTSS
TGSPGTPGSGTASSSPGASPGTSSTGSPGASPGTSSTGSPGASPGTSSTGSPGASPGTSSTGSPGSSPSASTGTGPGTPGSGT
ASSSPGASPGTSSTGSPGASPGTSSTGSPGASPGTSSTGSPGSSTPSGATGSPGSSTPSGATGSPGASPGT
SSTGSPGTPGSGTASSSPGSSTPSGATGSPGSSTPSGATGSPGSSTPSGATGSPGSSPSASTGTGPGASPG
TSSTGSPGASPGTSSTGSPGTPGSGTASSSPGASPGTSSTGSPGASPGTSSTGSPGASPGTSSTGSPGASP
GTSSTGSPGTPGSGTASSSPGSSTPSGATGSPGTPGSGTASSSPGSSTPSGATGSPGTPGSGTASSSPGSS
TPSGATGSPGSSTPSGATGSPGSSPSATASSSPGSSTPSGATGSSTGTGPGSSPSASTGTGPGASPGTSST
GSPGTPGSGTASSSPGSSTPSGATGSPGSSPSASTGTGPGSSPSASTGTGPGASPGTSSTGSPGASPGTSS
TGSPGSSTPSGATGSPGSSPSASTGTGPGASPGTSSTGSPGSSPSASTGTGPGTPGSGTASSSPGSSTPSG
ATGSPGSSTPSGATGSPGASPGTSSTGSP

AG288

ASSSPGASPGTSSTGSPGASPGTSSTGSPGASPGTSSTGSPGASPGTSSTGSPGTPGSGTASSSPGSST
PSGATGSPGTPGSGTASSSPGSSTPSGATGSPGTPGSGTASSSPGSSTPSGATGSPGSSTPSGATGSPG
SSPSASTGTGPGSSPSASTGTGPGASPGTSSTGSPGTPGSGTASSSPGSSTPSGATGSPGSSPSASTGT
GPGSSPSASTGTGPGASPGTSSTGSPGASPGTSSTGSPGSSTPSGATGSPGSSPSASTGTGPGASPGTS
STGSPGSSPSASTGTGPGTPGSGTASSSPGSSTPSGATGS

GASPGTSSTGSPGSSPSASTGTGPGSSPSASTGTGPGTPGSGTASSSPGSSTPSGATGSPGSSPSASTGTG
PGASPGTSSTGSPGTPGSGTASSSPGSSTPSGATGSPGTPGSGTASSSPGASPGTSSTGSPGASPGTSSTG
SPGTPGSGTASSSPGSSTPSGATGSPGASPGTSSTGSPGTPGSGTASSSPGSSTPSGATGSPGSSPSASTG
TGPGSSPSASTGTGPGSSTPSGATGSPGSSTPSGATGSPGASPGTSSTGSPGASPGTSSTGSPGASPGTSS
TGSPGTPGSGTASSSPGASPGTSSTGSPGASPGTSSTGSPGASPGTSSTGSPGSSPSASTGTGPGTPGSGT
ASSSPGASPGTSSTGSPGASPGTSSTGSPGASPGTSSTGSPGSSTPSGATGSPGSSTPSGATGSPGASPGT
SSTGSPGTPGSGTASSSPGSSTPSGATGSPGSSTPSGATGSPGSSTPSGATGSPGSSPSASTGTGPGASPG
TSSTGSPGASPGTSSTGSPGTPGSGTASSSPGASPGTSSTGSPGASPGTSSTGSPGASPGTSSTGSPGASP
GTSSTGSPGTPGSGTASSSPGSSTPSGATGSPGTPGSGTASSSPGSSTPSGATGSPGTPGSGTASSSPGSS
TPSGATGSPGSSTPSGATGSPGSSPSASTGTGPGSSPSASTGTGPGASPGTSSTGSPGTPGSGTASSSPGS
STPSGATGSPGSSPSASTGTGPGSSPSASTGTGPGASPGTSSTGSPGASPGTSSTGSPGSSTPSGATGSPG
SSPSASTGTGPGASPGTSSTGSPGSSPSASTGTGPGTPGSGTASSSPGSSTPSGATGSPGSSTPSGATGSP
GASPGTSSTGSP

AG144

PGSSPSASTGTGPGSSPSASTGTGPGTPGSGTASSSPGSSTPSGATGSPGSSPSASTGTGPGASPGTSS
TGSPGTPGSGTASSSPGSSTPSGATGSPGTPGSGTASSSPGASPGTSSTGSPGASPGTSSTGSPGTPGS
GTASSS

GSPAGSPTSTEEGTSESATPESGPGTSTEPSEGSAPGSPAGSPTSTEEGTSTEPSEGSAPGTSTEPSEGSA
PGTSESATPESGPGSEPATSGSETPGSEPATSGSETPGSPAGSPTSTEEGTSESATPESGPGTSTEPSEGS
APGTSTEPSEGSAPGSPAGSPTSTEEGTSTEPSEGSAPGTSTEPSEGSAPGTSESATPESGPGTSTEPSEG
SAPGTSESATPESGPGSEPATSGSETPGTSTEPSEGSAPGTSTEPSEGSAPGTSESATPESGPGTSESATP
ESGPGSPAGSPTSTEEGTSESATPESGPGSEPATSGSETPGTSESATPESGPGTSTEPSEGSAPGTSTEPS
EGSAPGTSTEPSEGSAPGTSTEPSEGSAPGTSTEPSEGSAPGTSTEPSEGSAPGSPAGSPTSTEEGTSTEP
SEGSAPGTSESATPESGPGSEPATSGSETPGTSESATPESGPGSEPATSGSETPGTSESATPESGPGTSTE
PSEGSAPGTSESATPESGPGSPAGSPTSTEEGSPAGSPTSTEEGSPAGSPTSTEEGTSESATPESGPGTST
EPSEGSAPGTSESATPESGPGSEPATSGSETPGTSESATPESGPGSEPATSGSETPGTSESATPESGPGTS
TEPSEGSAPGSPAGSPTSTEEGTSESATPESGPGSEPATSGSETPGTSESATPESGPGSPAGSPTSTEEGS
PAGSPTSTEEGTSTEPSEGSAPGTSESATPESGPGTSESATPESGPGTSESATPESGPGSEPATSGSETPG
SEPATSGSETPGSPAGSPTSTEEGTSTEPSEGSAPGTSTEPSEGSAPGSEPATSGSETPGTSESATPESGP
GTSTEPSEGSAP

AE576

GSPAGSPTSTEEGTSESATPESGPGTSTEPSEGSAPGSPAGSPTSTEEGTSTEPSEGSAPGTSTEPSEG
SAPGTSESATPESGPGSEPATSGSETPGSEPATSGSETPGSPAGSPTSTEEGTSESATPESGPGTSTEP
SEGSAPGTSTEPSEGSAPGSPAGSPTSTEEGTSTEPSEGSAPGTSTEPSEGSAPGTSESATPESGPGTS
TEPSEGSAPGTSESATPESGPGSEPATSGSETPGTSTEPSEGSAPGTSTEPSEGSAPGTSESATPESGP
GTSESATPESGPGSPAGSPTSTEEGTSESATPESGPGSEPATSGSETPGTSESATPESGPGTSTEPSEG
SAPGTSTEPSEGSAPGTSTEPSEGSAPGTSTEPSEGSAPGTSTEPSEGSAPGTSTEPSEGSAPGSPAGS
PTSTEEGTSTEPSEGSAPGTSESATPESGPGSEPATSGSETPGTSESATPESGPGSEPATSGSETPGTS
ESATPESGPGTSTEPSEGSAPGTSESATPESGPGSPAGSPTSTEEGSPAGSPTSTEEGSPAGSPTSTEE
GTSESATPESGPGTSTEPSEGSAP

GSPAGSPTSTEEGTSESATPESGPGTSTEPSEGSAPGSPAGSPTSTEEGTSTEPSEGSAPGTSTEPSEGSA
PGTSESATPESGPGSEPATSGSETPGSEPATSGSETPGSPAGSPTSTEEGTSESATPESGPGTSTEPSEGS
APGTSTEPSEGSAPGSPAGSPTSTEEGTSTEPSEGSAPGTSTEPSEGSAPGTSESATPESGPGTSTEPSEG
SAPGTSESATPESGPGSEPATSGSETPGTSTEPSEGSAPGTSTEPSEGSAPGTSESATPESGPGTSESATP
ESGPGSPAGSPTSTEEGTSESATPESGPGSEPATSGSETPGTSESATPESGPGTSTEPSEGSAPGTSTEPS
EGSAPGTSTEPSEGSAPGTSTEPSEGSAPGTSTEPSEGSAPGTSTEPSEGSAPGSPAGSPTSTEEGTSTEP
SEGSAPGTSESATPESGPGSEPATSGSETPGTSESATPESGPGSEPATSGSETPGTSESATPESGPGTSTE
PSEGSAPGTSESATPESGPGSPAGSPTSTEEGSPAGSPTSTEEGSPAGSPTSTEEGTSESATPESGPGTST
EPSEGSAP<u>GTSESATPESGPGSEPATSGSETPGTSESATPESGPGSEPATSGSETPGTSESATPESGPGTS
TEPSEGSAPGSPAGSPTSTEEGTSESATPESGPGSEPATSGSETPGTSESATPESGPGSPAGSPTSTEEGS
PAGSPTSTEEGTSTEPSEGSAPGTSESATPESGPGTSESATPESGPGTSESATPESGPGSEPATSGSETPG
SEPATSGSETPGSPAGSPTSTEEGTSTEPSEGSAPGTSTEPSEGSAPGSEPATSGSETPGTSESATPESGP
GTSTEPSEGSAP</u>

↓

AE288

GTSESATPESGPGSEPATSGSETPGTSESATPESGPGSEPATSGSETPGTSESATPESGPGTSTEPSEG
SAPGSPAGSPTSTEEGTSESATPESGPGSEPATSGSETPGTSESATPESGPGSPAGSPTSTEEGSPAGS
PTSTEEGTSTEPSEGSAPGTSESATPESGPGTSESATPESGPGTSESATPESGPGSEPATSGSETPGSE
PATSGSETPGSPAGSPTSTEEGTSTEPSEGSAPGTSTEPSEGSAPGSEPATSGSETPGTSESATPESGP
GTSTEPSEGSAP

FIG. 39E

BINDING FUSION PROTEINS, BINDING FUSION PROTEIN-DRUG CONJUGATES, XTEN-DRUG CONJUGATES AND METHODS OF MAKING AND USING SAME

CROSS-REFERENCE TO RELATED APPLICATIONS

This application claims the priority benefit of U.S. Provisional Application Ser. Nos. 61/341,720 filed Apr. 2, 2010, and 61/341,996 filed Apr. 8, 2010, which are hereby incorporated herein by reference in their entirety.

STATEMENT REGARDING FEDERALLY SPONSORED RESEARCH

This invention was made with government support under SBIR grant 2R44GM079873-02 awarded by the National Institutes of Health. The government has certain rights in the invention.

SEQUENCE LISTING

The instant application contains a Sequence Listing which has been submitted in ASCII format via EFS-Web and is hereby incorporated by reference in its entirety. Said ASCII copy, created on Dec. 27, 2012, is named 32808731.txt and is 2,247,117 bytes in size.

BACKGROUND OF THE INVENTION

Antibodies or immunoglobulins are molecules that recognize and bind to specific cognate antigens or ligands. Because of their exclusive specificities, antibodies, particularly monoclonal antibodies, have been widely used in the diagnosis and treatment of a variety of human diseases.

Full-length antibodies comprise two heavy chains linked together by disulfide bonds and two light chains, each light chain being linked to one of the heavy chains by a disulfide bond. Each chain has a variable domain ($V_H$ or $V_L$) at the N-terminus and one or more constant domains at the C-terminus; the constant domain of the light chain is aligned with and disulfide bonded to the first constant domain of the heavy chain, and the light chain variable domain is aligned with the variable domain of the heavy chain. Each of the variable domains of the heavy and light chain includes framework regions (FRs) and hypervariable regions and an intrachain disulfide bond. (See e.g. Chothia et al., *J. Mol. Biol.* 186:651-663 (1985); Novotny and Haber, *Proc. Natl. Acad. Sci. USA* 82:45924596 (1985); Padlar et al., *Mol. Immunol.*, 23(9): 951-960 (1986); and S. Miller, *J. Mol. Biol.*, 216:965-973 (1990). Antibodies can be derived from native antibodies or synthesized that may include combinations of heavy and light chain variable domains so as to form an antigen binding site. The types of antibody fragments include, for example, Fab, Fab', F(ab')$_2$, Fv, scFv, Fd, and Fd' fragments. However, expression of antibody fragments in bacterial hosts, including domain antibody fragments (dAb), Fv fragments, single-chain Fv fragments (scFv), Fab fragments, Fab'2 fragments, and many non-antibody proteins (such as FnIII domains) can result in the formation of inclusion bodies in the cytoplasm, adding to the complexity and cost of production (Kou, G., et al., 2007, Protein Expr Purif. 52, 131; Cao, P., et al. 2006, Appl Microbiol Biotechnol., 73, 151; Chen, L. H et al., 2006, Protein Expr Purif.; 46, 495). In addition, the stability and/or production yields of scFv or Fab fragments of natural antibodies produced in host cells have been found to be insufficient. Honneger et al., *J. Mol. Biol.*, 309:687-699 (2001), and the stability of scFv fragments is not always correlated with expression yield in the bacterial periplasm (Worn et al., *J. Mol. Biol.*, 305:989-1010 (2001). The many factors that affect the periplasmic expression yield and/or stability of scFv are not yet fully understood and may be unpredictable. In addition, the procedures for extracting periplasmic proteins are not as robust as extraction from the cytoplasm, which contributes to low yields. Thus, because there remains a need for improving the process of producing antibodies and antibody fragments, particularly in soluble form, finding alternative proteins that can bind antigens and that can be produced with improved yields in cell culture, especially with a bacterial cell culture, is desirable.

SUMMARY OF THE INVENTION

The present invention relates generally to novel, selectable binding fusion proteins useful as agents for the treatment of any disease or condition that is improved, ameliorated, or inhibited by the administration of proteins that bind certain proteins, carbohydrates or glycoprotein targets associated with the disease, disorder or condition. In particular, the present invention provides compositions of binding fusion proteins comprising extended recombinant polypeptides with a non-repetitive sequence and unstructured conformation (XTEN) linked to one or more polypeptide targeting moieties exhibiting binding affinity to certain targets. The binding fusion proteins of the embodiments disclosed herein exhibit one or more or any combination of the properties and/or the embodiments as detailed herein.

In some embodiments, the invention provides isolated binding fusion proteins comprising an extended recombinant polypeptide (XTEN) linked to a targeting moiety with binding affinity to a target selected from Table 1 or Table 2, wherein the fusion protein exhibits a terminal half-life that is longer than about 48 h, or about 72 h, or about 96 h, or about 120 h, or about 10 days, or about 21 days, or about 30 days when administered to a subject. In one embodiment of the foregoing, the XTEN is characterized in that the sequence comprises at least about 36, or at least about 72, or at least about 98, or at least about 144, or at least about 288, or at least about 576, or at least about 864, or at least about 1000, or at least about 1400, or at least about 2000, to about 3000 amino acid residues, the sum of glycine (G), alanine (A), serine (S), threonine (T), glutamate (E) and proline (P) residues constitutes more than about 80%, or about 85%, or about 90%, or about 95%, or about 96%, or about 97%, or about 98%, or about 99%, or about 100%, of the total amino acid sequence of the XTEN, the XTEN sequence is substantially non-repetitive in that (i) the XTEN sequence contains no three contiguous amino acids that are identical unless the amino acids are serine, (ii) at least about 80% of the XTEN sequence consists of non-overlapping sequence motifs, each of the sequence motifs comprising about 9 to about 14 amino acid residues, wherein any two contiguous amino acid residues does not occur more than twice in each of the sequence motifs; or (iii) the XTEN sequence has an average subsequence score of less than 3, the XTEN sequence lacks a predicted T-cell epitope when analyzed by TEPITOPE algorithm, wherein the TEPITOPE algorithm prediction for epitopes within the XTEN sequence is based on a score of −6, −7, or −8, or −9, or −10, the XTEN sequence has greater than 90% random coil formation, or about 95%, or about 96%, or about 97%, or about 98%, or about 99% random coil formation as determined by GOR algorithm; and the XTEN sequence has less than 2% alpha helices and 2% beta-sheets as determined by Chou-Fasman algorithm. In another embodiment of the foregoing, the XTEN is further characterized in that the sum of asparagine and glutamine residues is less than 10% of the total amino acid sequence of the XTEN, the sum of methionine and tryptophan residues is less than 2% of the total amino acid sequence of the XTEN.

In another embodiment, the XTEN of the binding fusion protein is further characterized in that no one type of amino acid constitutes more than about 16%, or 24%, or about 30% of the XTEN sequence. In another embodiment, the XTEN of the binding fusion protein is further characterized in that at least about 80%, or at least about 90%, or at least about 91%, or at least about 92%, or at least about 93%, or at least about 94%, or at least about 95%, or at least about 96%, or at least about 97%, or at least about 98%, or at least about 99% of the XTEN sequence consists of non-overlapping sequence motifs wherein each of the sequence motifs has about 12 amino acid residues and wherein the sequence of any two contiguous amino acid residues does not occur more than twice in each of the sequence motifs, and the sequence motifs consist of four to six types of amino acids selected from glycine (G), alanine (A), serine (S), threonine (T), glutamate (E) and proline (P). In one embodiment, greater than 90% of the XTEN sequence consists of non-overlapping sequence motifs, wherein the sequence motifs are from one or more sequences of Table 3. In another embodiment, the XTEN sequence exhibits at least about 80%, or at least about 90%, or at least about 91%, or at least about 92%, or at least about 93%, or at least about 94%, or at least about 95%, or at least about 96%, or at least about 97%, or at least about 98%, or at least about 99% or 100% sequence identity to a sequence selected from any one of Table 4, Table 11, Table 12, Table 13, Table 14, or Table 15, when optimally aligned. In another embodiment, the invention provides an isolated binding fusion protein comprising a sequence that has at least about 80%, or at least about 90%, or at least about 91%, or at least about 92%, or at least about 93%, or at least about 94%, or at least about 95%, or at least about 96%, or at least about 97%, or at least about 98%, or at least about 99% or 100% sequence identity to a sequence selected from any one of Table 25, Table 40 or Table 41.

The subject binding fusion proteins exhibit enhanced pharmacokinetic properties. In one embodiment the enhanced pharmacokinetic property is a terminal half-life that is greater than about 24 h, or greater than about 48 h, or greater than about 72 h, or greater than about 96 h, or greater than about 120 h, or greater than about 144 h, or greater than about 7 days, or greater than about 10 days, or greater than about 14 days, or greater than about 21 days when administered to a subject, wherein the pharmacokinetic properties are ascertained by measuring blood concentrations of the fusion protein over time after administration of a dose to a subject. In one embodiment, the enhanced pharmacokinetic property encompasses an increase in terminal half-life of at least about two fold, or at least about three-fold, or at least about four-fold, or at least about five-fold, or at least about six-fold, or at least about eight-fold, or at least about ten-fold, or at least about 20-fold compared to the targeting moiety not linked to the XTEN and administered to a subject at a comparable dose.

In one embodiment, the targeting moiety of the isolated binding fusion protein is selected from the group consisting of antibody, antibody fragment, scFv, diabody, domain antibody, cytokine receptor, and immunoglobulin superfamily receptor. In another embodiment, the targeting moiety is a scFv. In another embodiment, the targeting moiety is a scFv with binding affinity to Her2. In some embodiments, the binding fusion protein is multivalent, comprising two, or three, or four, or five, or six, or seven, or eight targeting moieties. In one embodiment of the foregoing, the multivalent targeting moiety is a scFv. In one embodiment the multivalent targeting moieties can exhibit specific binding affinity to the same target, wherein the targets are selected from Table 1 or Table 2. In one embodiment, the multivalent targeting moieties can exhibit specific binding affinity to two or more targets, wherein the targets are selected from Table 1 or Table 2. In any of the embodiments described in this paragraph, the binding affinity constant ($K_d$) for the one or more targeting moieties of the subject binding fusion protein and a target ligand is less than about $10^{-4}$ M, alternatively less than about $10^{-5}$ M, alternatively less than about $10^{-6}$ M, alternatively less than about $10^{-7}$ M, alternatively less than about $10^{-8}$ M, alternatively less than about $10^{-9}$ M, or less than about $10^{-10}$ M, or less than about $10^{-11}$ M, or less than about $10^{-12}$ M.

In one embodiment, the binding fusion protein can comprise a second XTEN having at least about 48 amino acid residues linked to the N-terminus of the binding fusion protein, wherein the expression of the binding fusion protein in a host cell comprising an expression vector coding the binding fusion protein is enhanced compared to the expression in a host cell comprising an expression vector encoding a corresponding binding fusion protein lacking the second XTEN. In one embodiment of the foregoing, the second XTEN exhibits at least 90% sequence identity, or at least about 91%, or at least about 92%, or at least about 93%, or at least about 94%, or at least about 95%, or at least about 96%, or at least about 97%, or at least about 98%, or at least about 99% or 100% sequence identity to an XTEN sequence selected from AE48, AM48, AE624, AE912 or AM923. In another embodiment of the foregoing, the incorporation into a host cell of a polynucleotide encoding a binding fusion protein comprising N-terminal XTEN can result in an expression level that is enhanced at least 50%, or at least about 75%, or at least about 100%, or at least about 150%, or at least about 200% or more compared to the expression levels in a comparable host cell with a polynucleotide encoding a binding fusion protein without the N-terminal XTEN.

The invention provides binding fusion proteins in various configurations. In one embodiment, the invention provides an isolated binding fusion protein of formula I:

$$(XTEN)_x\text{-TM-}(XTEN)_y \qquad\qquad\qquad I$$

wherein independently for each occurrence, XTEN is an extended recombinant polypeptide comprising greater than about 36 to about 3000 amino acids with a substantially non-repetitive sequence wherein the sum of glycine (G), alanine (A), serine (S), threonine (T), glutamate (E) and proline (P) residues constitutes more than about 80% of the total amino acid sequence of the XTEN, x is either 0 or 1, y is either 0 or 1, wherein x+y≥1, and TM is a targeting moiety with specific binding affinity to a target selected from Table 1 or Table 2.

In another embodiment, the invention provides an isolated binding fusion protein of formula II:

$$(XTEN)_x\text{-TM1-L-TM2-}(XTEN)_y \qquad\qquad\qquad II$$

wherein independently for each occurrence, XTEN is an extended recombinant polypeptide comprising greater than about 36 to about 3000 amino acids with a substantially non-repetitive sequence wherein the sum of glycine (G), alanine (A), serine (S), threonine (T), glutamate (E) and proline (P) residues constitutes more than about 80% of the total amino acid sequence of the XTEN, x is either 0 or 1, y is either 0 or 1, wherein x+y≥1, TM1 is a targeting moiety with specific binding affinity to a target selected from Table 1, TM2 is a targeting moiety with binding affinity to a target selected from Table 1 or Table 2 that may be identical or may be different to TM1, and L is a linker sequence having between 1 to about 300 amino acid residues. In one embodiment, the linker can be a sequence in which at least 80% of the residues are comprised of amino acids glycine, serine, and/or glutamate, such as, but not limited to a sequence with about 80-100% sequence identify to the sequence GSGEGSEG-EGGGEGSEGEGSGEGGEGEGSG (SEQ ID NO: 1), or a portion or a multimer thereof.

In another embodiment, the invention provides an isolated binding fusion protein of formula III

TM1-XTEN-TM2    III wherein independently for each occurrence XTEN is an extended recombinant polypeptide comprising greater than about 400 to about 3000 amino acids with a substantially non-repetitive sequence wherein the sum of glycine (G), alanine (A), serine (S), threonine (T), glutamate (E) and proline (P) residues constitutes more than about 80% of the total amino acid sequence of the XTEN, x is either 0 or 1, y is either 0 or 1, wherein x+y≥1, TM1 is a targeting moiety with specific binding affinity to a target ligand selected from Table 1 or Table 2; and TM2 is a targeting moiety with binding affinity to a target selected from Table 1 or Table 2 that may be identical or may be different to the target bound by TM1, In another embodiment, the invention provides a multivalent binding fusion protein with three binding moieties of formula IV:

(XTEN)$_x$-TM1-L1-TM2-L2-TM3-(XTEN)$_y$    IV wherein independently for each occurrence: XTEN is an extended recombinant polypeptide as described above, x is either 0 or 1; y is either 0 or 1, wherein x+y≥1; TM1 is a targeting moiety with binding affinity to a target ligand selected from Table 1 or Table 2; TM2 is a targeting moiety with binding affinity to the target ligand selected from Table 1 or Table 2 that may be identical or may be different to TM1; TM3 is a targeting moiety with binding affinity to the target ligand selected from Table 1 or Table 2 that may be identical or may be different to either TM1 or TM2; L1 is a linker sequence having between 1 to about 300 amino acid residues as described for formula II, and wherein the linker sequence is covalently bound to the C terminus of TM1 and the N terminus of TM2; and L2 is a linker sequence that may be identical to or different from L1, having between 1 to about 300 amino acid residues as described as for formula II, and wherein the linker sequence is covalently bound to the C terminus of TM2 and the N terminus of TM3.

In some embodiments, the invention provides an isolated fusion protein with a single targeting moiety, wherein the targeting moiety exhibits binding specific affinity to a target selected from Table 1 or Table 2. In one embodiment of the foregoing, the target is selected from IL17, IL17R, RSV, HER2, IL12, IL23, RANKL, NGF, CD80, CD86, CD3, CD40, EGFR, TNFalpha, cMET, IL6R, and elastase. In other embodiments, the invention provides an isolated fusion protein with multiple targeting moieties (e.g., two, or three, or four, or five, or six, or seven or more targeting moieties) wherein the targeting moiety exhibits binding affinity to one or more targets selected from Table 1 or Table 2. In one embodiment of the foregoing, the one or more targets are selected from IL17, IL17R, RSV, HER2, IL12, IL23, RANKL, NGF, CD80, CD86, CD3, CD40, EGFR, TNFalpha, cMET, IL6R, and elastase. In a preferred embodiment of the foregoing, the two or more targeting moieties are scFv. In any of the embodiments hereinabove described in this paragraph, the binding affinity constant ($K_d$) for the one or more targeting moieties of the subject binding fusion protein and a target ligand is less than about $10^{-5}$ M, alternatively less than about $10^{-6}$ M, alternatively less than about $10^{-7}$ M, alternatively less than about $10^{-8}$ M, alternatively less than about $10^{-9}$ M, or less than about $10^{-10}$ M, or less than about $10^{-11}$ M, or less than about $10^{-12}$ M.

In some embodiments, binding fusion proteins exhibit an increased apparent molecular weight as determined by size exclusion chromatography, compared to the actual molecular weight, wherein the apparent molecular weight is at least about 100 kD, 150 kD, 200 kD, 300 kD, 400 kD, 500 kD, 600 kD, or 700 kD, while the actual molecular weight of the fusion protein is less than about 25 kD. Accordingly, the binding fusion proteins can have an apparent molecular weight that is about 4-fold greater, or about 5-fold greater, or about 6-fold greater, or about 7-fold greater, or about 8-fold greater than the actual molecular weight of the binding fusion protein. In one embodiment, the isolated binding fusion protein of the foregoing embodiments exhibits an apparent molecular weight factor under physiologic conditions that is greater than about 4, or about 5, or about 6, or about 7, or about 8.

In another embodiment, the invention provides isolated binding fusion protein of any one of the preceding embodiments, further comprising one or more molecules of a drug selected from Table 9.

In one embodiment, the drug is covalently attached by a cross-linker to the XTEN, preferably through one or more cysteine or lysine amino acid residues incorporated into the XTEN. In another embodiment, the drug is covalently attached by a cross-linker to the targeting moiety, preferably through one or more cysteine or lysine amino acid residues incorporated into the targeting moiety. The binding fusion protein drug conjugates can be in different configurations. In one embodiment, the invention provides a binding fusion protein-drug conjugate composition of formula V:

[(D-CL)$_{z1}$-XTEN]$_x$-TM-[XTEN-(CL-D)$_{z2}$]$_y$    V wherein independently for each occurrence: x is either 0 or 1; y is either 0 or 1; XTEN is a cysteine- or lysine-engineered extended recombinant polypeptide as described above; TM is a targeting moiety with binding affinity to a target ligand selected from Table 1 or Table 2 (which may comprise more than one binding domain joined by linkers); CL is a cross-linker as defined herein; D is a drug moiety selected from Table 9 or a pharmaceutically acceptable salt, acid or derivative thereof; and z1 and z2 each are independently an integer from 1 to 100. Exemplary binding fusion protein-drug conjugate compositions of Formula V can comprise XTEN that have from 1 to about 100 cysteine or lysine engineered amino acids, or from 1 to about 50 cysteine or lysine engineered amino acids, or from 1 to about 40 cysteine or lysine engineered amino acids, or from 1 to about 20 cysteine or lysine engineered amino acids, or from 1 to about 10 cysteine or lysine engineered amino acids, or from 1 to about 5 cysteine or lysine engineered amino acids that are available for conjugation to drug molecules.

In another embodiment, the invention provides a binding fusion protein-drug conjugate composition of formula VI:

[(D-CL)$_{z1}$-XTEN]$_x$-TM1-L-TM2-[XTEN-(CL-D)$_{z2}$]$_y$    VI wherein independently for each occurrence: x is either 0 or 1, and y is either 0 or 1; XTEN is a either a cysteine- or lysine-engineered extended recombinant polypeptide as described; TM1 is a targeting moiety with binding affinity to a target ligand selected from Table 1 or Table 2 (which may comprise more than one binding domain joined by linkers); TM2 is a targeting moiety with binding affinity to a target ligand selected from Table 1 or Table 2 (which may comprise more than one binding domain joined by linkers) that may be identical or may be different to TM1; and L is a linker sequence having between 1 to about 300 amino acid residues wherein the linker sequence is covalently bound to the C terminus of TM1 and the N terminus of TM2; D is a drug moiety selected from Table 9 or a pharmaceutically acceptable salt, acid or derivative thereof; CL is a cross-linker as defined herein; and z1 and z2 each are independently an integer from 0 to 100. Exemplary binding fusion protein-drug conjugate compositions of Formula VI can comprise XTEN that have from 1 to about 100 cysteine or lysine engineered amino acids, or from 1 to about 50 cysteine or lysine engineered amino acids, or from 1 to about 40 cysteine or lysine engineered amino acids, or from 1 to about 20 cysteine or lysine engineered amino acids, or from 1 to about 10 cysteine or lysine engineered amino acids, or from 1 to about 5 cysteine or lysine engineered amino acids that are available for conjugation to drug molecules.

The invention provides compositions of the isolated binding fusion proteins of any of the foregoing embodiments. In one embodiment, the invention provides a pharmaceutical composition comprising a binding fusion protein of any of the foregoing embodiments and at least one pharmaceutically acceptable carrier. In another embodiment, the invention provides kits, comprising packaging material and at least a first container comprising the pharmaceutical composition of the foregoing embodiment and a label identifying the pharmaceutical composition and storage and handling conditions, and a sheet of instructions for the reconstitution and/or administration of the pharmaceutical compositions to a subject.

The invention further provides methods of use of the pharmaceutical compositions comprising the fusion protein of any of the foregoing embodiments in the treatment of a disease, disorder or condition in a subject in need thereof. In one embodiment of the method, the disease, disorder or condition is selected from the group consisting of breast carcinoma, lung carcinoma, gastric carcinoma, esophageal carcinoma, colorectal carcinoma, liver carcinoma, ovarian carcinoma, thecoma, arrhenoblastoma, cervical carcinoma, endometrial carcinoma, endometriosis, fibrosarcoma, choriocarcinoma, head and neck cancer, nasopharyngeal carcinoma, laryngeal carcinoma, hepatoblastoma, Kaposi's sarcoma, melanoma, skin carcinoma, hemangioma, cavernous hemangioma, hemangioblastoma, pancreas carcinoma, retinoblastoma, astrocytoma, glioblastoma, Schwannoma, oligodendroglioma, medulloblastoma, neuroblastoma, rhabdomyosarcoma, osteogenic sarcoma, leiomyosarcomas, urinary tract carcinoma, thyroid carcinoma, Wilm's tumor, renal cell carcinoma, and prostate carcinoma.

In one embodiment, the invention provides a method of treating a disease or condition mediated by or associated with a target of Table 1 or Table 2, comprising administering the pharmaceutical composition described above using a therapeutically effective amount to a subject in need thereof. In one embodiment, the target of Table 1 is a tumor associated antigen, such as but not limited to the antigens of Table 2. In one embodiment, the invention provides a method of treatment wherein the binding fusion protein exhibits binding to the tumor associated antigen HER2. In a one embodiment of the method, the administration of the pharmaceutical composition using a therapeutically effective amount to a subject has a growth inhibitory effect on a tumor cell. The method of treatment can comprise administering the pharmaceutical composition by an appropriate route, including subcutaneously, intramuscularly, intravitreally, or intravenously. In one embodiment, multiple consecutive doses of the pharmaceutical composition are administered at a therapeutically effective dose regimen, and can result in an improvement in at least one measured parameter relevant for the metabolic disease, disorder or condition. In one embodiment, the therapeutically effective dose regimen can be achieved using a two administrations of pharmaceutical composition per month dosing regimen for the length of the dosing period. In one embodiment, the therapeutically effective dose regimen is achieved using a one administration of pharmaceutical composition per month dosing regimen for the length of the dosing period. In another embodiment, the binding fusion protein has a growth inhibitory effect on SK-BR-3 cells in a cell culture assay.

The invention provides isolated nucleic acids comprising a polynucleotide sequence selected from (a) a polynucleotide encoding the binding fusion protein of any of the foregoing embodiments, or (b) the complement of the polynucleotide of (a). In one embodiment of the foregoing, the isolated nucleic acid comprises a polynucleotide sequence that has at least 80% sequence identity, or about 85%, or at least about 90%, or about 91%, or about 92%, or about 93%, or about 94%, or about 95%, or about 96%, or about 97%, or about 98%, or about 99% to about 100% sequence identity to (a) a polynucleotide sequence that encodes a polypeptide selected from any one of Table 25, Table 40 or Table 41; or (b) the complement of the polynucleotide of (a). The invention provides expression vectors comprising the nucleic acid of any of the embodiments hereinabove described in this paragraph. In one embodiment, the expression vector of the foregoing further comprises a recombinant regulatory sequence operably linked to the polynucleotide sequence. In another embodiment, the polynucleotide sequence of the expression vectors of the foregoing is fused in frame to a polynucleotide encoding a secretion signal sequence, which can be a prokaryotic signal sequence. In one embodiment, the secretion signal sequence is selected from OmpA, DsbA, and PhoA signal sequences.

The invention provides a host cell, which can comprise an expression vector disclosed in the foregoing paragraph. In one embodiment, the host cell is a prokaryotic cell, such as, but not limited to E. coli. In another embodiment, the host cell is a eukaryotic cell, such as, but not limited to CHO.

The invention also provides host cells comprising an expression vector, wherein the expression vector encodes a binding fusion protein comprising an N-terminal XTEN optimized for expression. In one embodiment of the foregoing, the vector comprises a sequence that encodes a polypeptide sequence that exhibits at least about 80%, more preferably at least about 90%, more preferably at least about 91%, more preferably at least about 92%, more preferably at least about 93%, more preferably at least about 94%, more preferably at least about 95%, more preferably at least about 96%, more preferably at least about 97%, more preferably at least about 98%, more preferably at least about 99%, or exhibits 100% sequence identity to the amino acid sequence of AE48. AM48, AE624, AE912, or AM923. In one embodiment, the expression level of the encoded binding fusion protein in the host cell is enhanced compared to the expression level in a corresponding host cell comprising an expression vector encoding a binding fusion protein lacking the N-terminal XTEN optimized for expression. In one embodiment, the expression level is enhanced at least about 50%, or about 75%, or about 100%, or about 150%, or about 200%, or about 400% compared to a corresponding binding fusion protein not comprising the N-terminal XTEN sequence.

INCORPORATION BY REFERENCE

All publications, patents, and patent applications mentioned in this specification are herein incorporated by reference to the same extent as if each individual publication, patent, or patent application was specifically and individually indicated to be incorporated by reference.

BRIEF DESCRIPTION OF THE DRAWINGS

The features and advantages of the invention may be further explained by reference to the following detailed description and accompanying drawings that sets forth illustrative embodiments.

FIG. 1(A-B) shows schematic representations of an exemplary scFv binding fusion protein with a single targeting moiety depicted in an N- to C-terminus orientation.

FIG. 2(A-B) shows schematic representations of exemplary components of a scFv binding fusion protein with two targeting moieties depicted in an N- to C-terminus orientation.

FIG. 3(A-B) shows schematic representations of an exemplary monomeric diabody binding fusion protein that can form two antigen binding sites.

FIG. 4(A-B) shows schematic representations of an exemplary VEGF cytokine binding fusion protein.

FIG. 6(A-D) shows schematic representations of exemplary genes that encode binding fusion proteins, all depicted in a 5' to 3' orientation, with all component sequences linked in frame.

FIG. 10(A-D) is a schematic representation of the design of anti-Her2 binding fusion protein expression vectors with different processing strategies.

FIG. 12 shows three randomized libraries used for the third and fourth codons in the N-terminal sequences of clones from LCW546, LCW547 and LCW552. The libraries were designed with the third and fourth residues modified such that all combinations of allowable XTEN codons were present at these positions, as shown. In order to include all the allowable XTEN codons for each library, nine pairs of oligonucleotides encoding 12 amino acid motifs with codon diversities of third and fourth residues were designed, annealed and ligated into the NdeI/BsaI restriction enzyme digested stuffer vector pCW0551 (Stuffer-XTEN_AM875-GFP), and transformed into *E. coli* BL21Gold(DE3) competent cells to obtain colonies of the three libraries LCW0569 (SEQ ID NOS 863-864), LCW0570 (SEQ ID NOS 865-866), and LCW0571 (SEQ ID NOS 867-868).

FIG. 17(A-C) shows the characterization of multivalent scFv binding fusion proteins.

FIG. 19(A-B) shows a schematic of two scFv binding fusion protein constructs with a GFP tag and flow cytometry results of cell binding assays.

FIG. 20 shows results from characterization assays of a bispecific scFv binding fusion protein, as described in Example 36. FIG. 20A shows an SDS-PAGE gel of the purified aHER2-aCD3-XTEN. FIG. 20B shows the output of a size exclusion chromatography (SEC) analysis of the aHER2-aCD3-XTEN compared to molecular weight standards, and demonstrates that no dimers or other higher-order oligomers are formed and that the protein has an approximate apparent molecular weight of approximately 500 kDa, approximately five-fold higher than the mass indicated in the SDS-PAGE assay of FIG. 20A.

FIG. 24(A-B) shows schematic representations of single and multivalent Vhh binding fusion protein constructs and their characterization.

FIG. 26(A-B) shows results of binding characterization ELISA assays of monomeric and multivalent targeting moiety anti-EGFR Vhh binding fusion protein constructs, as described in Example 38 (the constructs depicted schematically in FIG. 24A).

FIG. 28(A-B) shows the results of characterization assays for an anti-IL6R binding fusion protein.

FIG. 34(A-C) shows output of flow cytometry assays for the three fusion proteins described in FIG. 33 compared to unlabeled Herceptin and control IgG-AF680 conjugate, measuring forward and side scatter vs. FL4 for Alexa680, as described in Example 41.

FIG. 39(A-E) illustrates the use of donor XTEN sequences to produce truncated XTEN sequences. FIG. 39A provides the sequence of AG864 (SEQ ID NO: 870), with the underlined sequence used to generate an AG576 (SEQ ID NO: 871) sequence. FIG. 39B provides the sequence of AG864 (SEQ ID NO: 872), with the underlined sequence used to generate an AG288 (SEQ ID NO: 873) sequence. FIG. 39C provides the sequence of AG864 (SEQ ID NO: 874), with the underlined sequence used to generate an AG144 (SEQ ID NO: 875) sequence. FIG. 39D provides the sequence of AE864 (SEQ ID NO: 876), with the underlined sequence used to generate an AE576 (SEQ ID NO: 877) sequence. FIG. 39E provides the sequence of AE864 (SEQ ID NO: 878), with the underlined sequence used to generate an AE288 (SEQ ID NO: 879) sequence.

FIG. 40(A-D) shows various schematic examples of XTEN-based protein-drug conjugates, with the chemically conjugated drug-crosslinker ligand designated "D".

FIG. 41(A-D) shows various schematic examples of the conjugation process to make conjugates with multiple drug ligands using orthogonal coupling chemistries.

FIG. 42(A-B) shows results of analytical assays of XTEN conjugated with cross-linked FITC, as described in Example 63.

DETAILED DESCRIPTION OF THE INVENTION

Figures 1A, 1B:
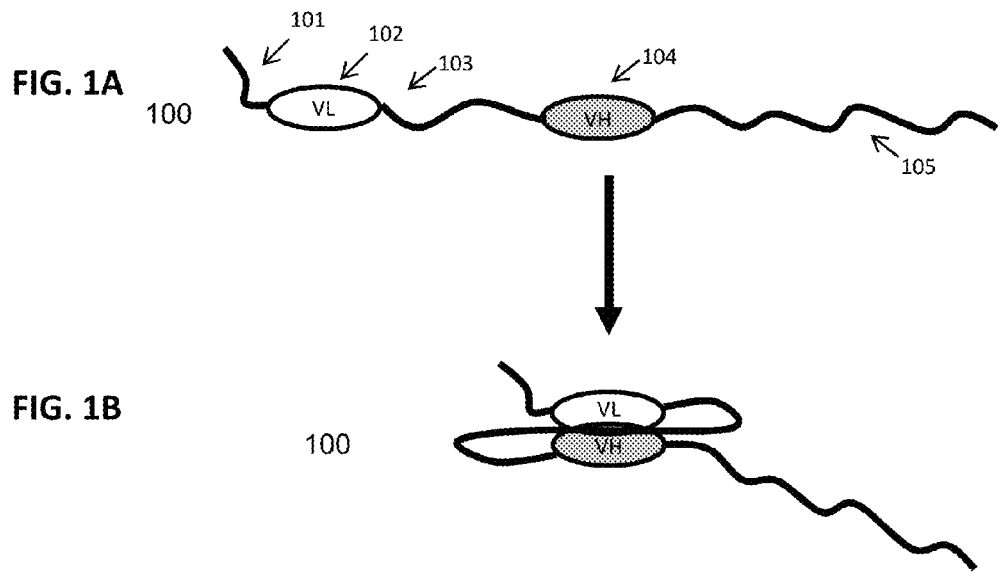
FIG. 1A shows the configuration of a scFv binding fusion protein (100) with the single chain Fv targeting moiety in a "relaxed" conformation, comprising an N-terminal XTEN sequence (101), a VL binding domain sequence (102), a linker sequence (103), a VH binding domain sequence (104), and an XTEN carrier sequence (105) at the C-terminus.
FIG. 1B shows the flexible linker permitting the two binding domains to come into association to form the antigen binding site of the scFv targeting moiety.

Before the embodiments of the invention are described, it is to be understood that such embodiments are provided by way of example only, and that various alternatives to the embodiments of the invention described herein may be employed in practicing the invention. Numerous variations, changes, and substitutions will now occur to those skilled in the art without departing from the invention.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. In case of conflict, the patent specification, including definitions, will control. In addition, the materials, methods, and examples are illustrative only and not intended to be limiting. Numerous variations, changes, and substitutions will now occur to those skilled in the art without departing from the invention.

DEFINITIONS

As used herein, the following terms have the meanings ascribed to them unless specified otherwise.

As used in the specification and claims, the singular forms "a", "an" and "the" include plural references unless the context clearly dictates otherwise. For example, the term "a cell" includes a plurality of cells, including mixtures thereof.

The terms "polypeptide", "peptide", and "protein" are used interchangeably herein to refer to polymers of amino acids of any length. The polymer may be linear or branched, it may comprise modified amino acids, and it may be interrupted by non-amino acids. The terms also encompass an amino acid polymer that has been modified, for example, by disulfide bond formation, glycosylation, lipidation, acetylation, phosphorylation, or any other manipulation, such as conjugation with a labeling component.

As used herein the term "amino acid" refers to either natural and/or unnatural or synthetic amino acids, including but not limited to glycine and both the D or L optical isomers, and amino acid analogs and peptidomimetics. Standard single or three letter codes are used to designate amino acids.

The term "natural L-amino acid" means the L optical isomer forms of glycine (G), proline (P), alanine (A), valine (V), leucine (L), isoleucine (I), methionine (M), cysteine (C), phenylalanine (F), tyrosine (Y), tryptophan (W), histidine (H), lysine (K), arginine (R), glutamine (Q), asparagine (N), glutamic acid (E), aspartic acid (D), serine (S), and threonine (T).

The term "non-naturally occurring," as applied to sequences and as used herein, means polypeptide or polynucleotide sequences that do not have a counterpart to, are not complementary to, or do not have a high degree of homology with a wild-type or naturally-occurring sequence found in a mammal. For example, a non-naturally occurring polypeptide or fragment may share no more than 99%, 98%, 95%, 90%, 80%, 70%, 60%, 50% or even less amino acid sequence identity as compared to a natural sequence when suitably aligned.

The terms "hydrophilic" and "hydrophobic" refer to the degree of affinity that a substance has with water. A hydrophilic substance has a strong affinity for water, tending to dissolve in, mix with, or be wetted by water, while a hydrophobic substance substantially lacks affinity for water, tending to repel and not absorb water and tending not to dissolve in or mix with or be wetted by water Amino acids can be characterized based on their hydrophobicity. A number of scales have been developed. An example is a scale developed by Levitt, M, et al., J Mol Biol (1976) 104:59, which is listed in Hopp, T P, et al., Proc Natl Acad Sci USA (1981) 78:3824. Examples of "hydrophilic amino acids" are arginine, lysine, threonine, alanine, asparagine, and glutamine. Of particular interest are the hydrophilic amino acids aspartate, glutamate, and serine, and glycine. Examples of "hydrophobic amino acids" are tryptophan, tyrosine, phenylalanine, methionine, leucine, isoleucine, and valine.

A "fragment" is a truncated form of a native biologically active protein that retains at least a portion of the therapeutic and/or biological activity. A "variant" is a protein with sequence homology to the native biologically active protein that retains at least a portion of the therapeutic and/or biological activity of the biologically active protein. For example, a variant protein may share at least 70%, 75%, 80%, 85%, 90%, 95%, 96%, 97%, 98% or 99% amino acid sequence identity with the reference biologically active protein. As used herein, the term "biologically active protein moiety" includes proteins modified deliberately, as for example, by site directed mutagenesis, insertions, or accidentally through mutations.

A "host cell" includes an individual cell or cell culture which can be or has been a recipient for the subject vectors. Host cells include progeny of a single host cell. The progeny may not necessarily be completely identical (in morphology or in genomic of total DNA complement) to the original parent cell due to natural, accidental, or deliberate mutation. A host cell includes cells transfected in vivo with a vector of this invention.

"Isolated," when used to describe the various polypeptides disclosed herein, means polypeptide that has been identified and separated and/or recovered from a component of its natural environment. Contaminant components of its natural environment are materials that would typically interfere with diagnostic or therapeutic uses for the polypeptide, and may include enzymes, hormones, and other proteinaceous or non-proteinaceous solutes. As is apparent to those of skill in the art, a non-naturally occurring polynucleotide, peptide, polypeptide, protein, antibody, or fragments thereof, does not require "isolation" to distinguish it from its naturally occurring counterpart. In addition, a "concentrated", "separated" or "diluted" polynucleotide, peptide, polypeptide, protein, antibody, or fragments thereof, is distinguishable from its naturally occurring counterpart in that the concentration or number of molecules per volume is generally greater than that of its naturally occurring counterpart. In general, a polypeptide made by recombinant means and expressed in a host cell is considered to be "isolated."

An "isolated" polynucleotide or polypeptide-encoding nucleic acid or other polypeptide-encoding nucleic acid is a nucleic acid molecule that is identified and separated from at least one contaminant nucleic acid molecule with which it is ordinarily associated in the natural source of the polypeptide-encoding nucleic acid. An isolated polypeptide-encoding nucleic acid molecule is other than in the form or setting in which it is found in nature. Isolated polypeptide-encoding nucleic acid molecules therefore are distinguished from the specific polypeptide-encoding nucleic acid molecule as it exists in natural cells. However, an isolated polypeptide-encoding nucleic acid molecule includes polypeptide-encoding nucleic acid molecules contained in cells that ordinarily express the polypeptide where, for example, the nucleic acid molecule is in a chromosomal or extra-chromosomal location different from that of natural cells.

A "chimeric" protein contains at least one fusion polypeptide comprising regions in a different position in the sequence than that which occurs in nature. The regions may normally exist in separate proteins and are brought together in the fusion polypeptide; or they may normally exist in the same protein but are placed in a new arrangement in the fusion polypeptide. A chimeric protein may be created, for example, by chemical synthesis, or by creating and translating a polynucleotide in which the peptide regions are encoded in the desired relationship.

"Conjugated" and "conjugation" refers to the covalent joining together of two or more chemical elements or components by chemical reaction, rather than recombinantly; e.g., a drug and an XTEN.

A "cross-linker" or "CL" means a chemical moiety comprising a covalent bond, drug-linker, or a chain of atoms that covalently conjugate a drug moiety to a protein. Cross-linker components can comprise one or two reactive groups to facilitate the conjugation of a drug and a protein, and the reactive groups can have been blocked by protecting groups to permit the selective conjugation with a given drug or protein reactant.

A "reactive group" is a chemical structure or functional group that is part of or that can be coupled to a reactant for conjugation. Examples for reactive groups are amino groups, carboxyl groups, sulfhydryl groups, hydroxyl groups, aldehyde groups, azide groups. Some reactive groups can be activated to facilitate coupling with a second reactive group, such as a cross-linker component. Examples for activation are the reaction of a carboxyl group with carbodiimide, the conversion of a carboxyl group into an activated ester, the conversion of a carboxyl group into an azide function, or the conversion of a hydroxyl to a thiol.

The term "cytotoxic agent" as used herein refers to a substance that causes destruction of cells. The term is intended to include radioactive isotopes, drugs, and toxins such as small molecule toxins or enzymatically active toxins of bacterial, fungal, plant or animal origin, including synthetic analogs and derivatives thereof.

The term "cytostatic agent" refers to a substance that has the effect of limiting the function of cells, such as limiting cellular growth or proliferation of cells.

A "drug" is a non-protein chemical compound useful in the treatment of a disease, disorder or condition in a subject; e.g., cancer, inflammatory diseases or conditions such as rheumatoid arthritis, metabolic disorders such as diabetes, infectious diseases, diseases of the organs such as asthma, or generalized conditions such as pain and hypertension, etc. Administration of a drug to a subject or to a cell can, for example, result in a pharmacologic effect, a therapeutic effect, an inhibitory effect, or result in cell death.

In the context of polypeptides, "fusion", "fused" and "linked," are used interchangeably herein. These terms refer to the joining together of two more protein components, by whatever means including chemical conjugation or recombinant means. For example, a promoter or enhancer is operably linked to a coding sequence if it affects the transcription of the sequence. Generally, "operably linked" means that the DNA sequences being linked are contiguous, and in reading phase or in-frame. An "in-frame fusion" refers to the joining of two or more open reading frames (ORFs) to form a continuous longer ORF, in a manner that maintains the correct reading frame of the original ORFs. Thus, the resulting recombinant fusion protein is a single protein containing two ore more segments that correspond to polypeptides encoded by the original ORFs (which segments are not normally so joined in nature).

In the context of polypeptides, a "linear sequence" or a "sequence" is an order of amino acids in a polypeptide in an amino to carboxyl terminus direction in which residues that neighbor each other in the sequence are contiguous in the primary structure of the polypeptide. A "partial sequence" is a linear sequence of part of a polypeptide that is known to comprise additional residues in one or both directions.

"Heterologous" means derived from a genotypically distinct entity from the rest of the entity to which it is being compared. For example, a glycine rich sequence removed from its native coding sequence and operatively linked to a coding sequence other than the native sequence is a heterologous glycine rich sequence. The term "heterologous" as applied to a polynucleotide, a polypeptide, means that the polynucleotide or polypeptide is derived from a genotypically distinct entity from that of the rest of the entity to which it is being compared.

The terms "polynucleotides", "nucleic acids", "nucleotides" and "oligonucleotides" are used interchangeably. They refer to a polymeric form of nucleotides of any length, either deoxyribonucleotides or ribonucleotides, or analogs thereof. Polynucleotides may have any three-dimensional structure, and may perform any function, known or unknown. The following are non-limiting examples of polynucleotides: coding or non-coding regions of a gene or gene fragment, loci (locus) defined from linkage analysis, exons, introns, messenger RNA (mRNA), transfer RNA, ribosomal RNA, ribozymes, cDNA, recombinant polynucleotides, branched polynucleotides, plasmids, vectors, isolated DNA of any sequence, isolated RNA of any sequence, nucleic acid probes, and primers. A polynucleotide may comprise modified nucleotides, such as methylated nucleotides and nucleotide analogs. If present, modifications to the nucleotide structure may be imparted before or after assembly of the polymer. The sequence of nucleotides may be interrupted by non-nucleotide components. A polynucleotide may be further modified after polymerization, such as by conjugation with a labeling component.

The term "complement of a polynucleotide" denotes a polynucleotide molecule having a complementary base sequence and reverse orientation as compared to a reference sequence, such that it could hybridize with a reference sequence with complete fidelity.

"Recombinant" as applied to a polynucleotide means that the polynucleotide is the product of various combinations of in vitro cloning, restriction and/or ligation steps, and other procedures that result in a construct that can potentially be expressed in a host cell.

The terms "gene" or "gene fragment" are used interchangeably herein. They refer to a polynucleotide containing at least one open reading frame that is capable of encoding a particular protein after being transcribed and translated. A gene or gene fragment may be genomic or cDNA, as long as the polynucleotide contains at least one open reading frame, which may cover the entire coding region or a segment thereof. A "fusion gene" is a gene composed of at least two heterologous polynucleotides that are linked together.

"Homology" or "homologous" refers to sequence similarity or interchangeability between two or more polynucleotide sequences or two or more polypeptide sequences. When using a program such as BestFit to determine sequence identity, similarity or homology between two different amino acid sequences, the default settings may be used, or an appropriate scoring matrix, such as blosum45 or blosum80, may be selected to optimize identity, similarity or homology scores. Preferably, polynucleotides that are homologous are those which hybridize under stringent conditions as defined herein and have at least 70%, preferably at least 80%, more preferably at least 90%, more preferably 95%, more preferably 97%, more preferably 98%, and even more preferably 99% sequence identity to those sequences.

The terms "stringent conditions" or "stringent hybridization conditions" includes reference to conditions under which a polynucleotide will hybridize to its target sequence, to a detectably greater degree than other sequences (e.g., at least 2-fold over background). Generally, stringency of hybridization is expressed, in part, with reference to the temperature and salt concentration under which the wash step is carried out. Typically, stringent conditions will be those in which the salt concentration is less than about 1.5 M Na ion, typically about 0.01 to 1.0 M Na ion concentration (or other salts) at pH 7.0 to 8.3 and the temperature is at least about 30° C. for short polynucleotides (e.g., 10 to 50 nucleotides) and at least about 60° C. for long polynucleotides (e.g., greater than 50 nucleotides)—for example, "stringent conditions" can include hybridization in 50% formamide, 1 M NaCl, 1% SDS at 37° C., and three washes for 15 min each in 0.1×SSC/1% SDS at 60° C. to 65° C. Alternatively, temperatures of about 65° C., 60° C., 55° C., or 42° C. may be used. SSC concentration may be varied from about 0.1 to 2×SSC, with SDS being present at about 0.1%. Such wash temperatures are typically selected to be about 5° C. to 20° C. lower than the thermal melting point© for the specific sequence at a defined ionic strength and pH. The Tm is the temperature (under defined ionic strength and pH) at which 50% of the target sequence hybridizes to a perfectly matched probe. An equation for calculating Tm and conditions for nucleic acid hybridization are well known and can be found in Sambrook, J. et al. (1989) Molecular Cloning: A Laboratory Manual, $2^{nd}$ ed., vol. 1-3, Cold Spring Harbor Press, Plainview N.Y.; specifically see volume 2 and chapter 9. Typically, blocking reagents are used to block non-specific hybridization. Such blocking reagents include, for instance, sheared and denatured salmon sperm DNA at about 100-200 µg/ml. Organic solvent, such as formamide at a concentration of about 35-50% v/v, may also be used under particular circumstances, such as for RNA:DNA hybridizations. Useful variations on these wash conditions will be readily apparent to those of ordinary skill in the art.

The terms "percent identity" and "% identity," as applied to polynucleotide sequences, refer to the percentage of residue matches between at least two polynucleotide sequences aligned using a standardized algorithm. Such an algorithm may insert, in a standardized and reproducible way, gaps in the sequences being compared in order to optimize alignment between two sequences, and therefore achieve a more meaningful comparison of the two sequences. Percent identity may be measured over the length of an entire defined polynucleotide sequence, for example, as defined by a particular SEQ ID number, or may be measured over a shorter length, for example, over the length of a fragment taken from a larger, defined polynucleotide sequence, for instance, a fragment of at least 45, at least 60, at least 90, at least 120, at least 150, at least 210 or at least 450 contiguous residues. Such lengths are exemplary only, and it is understood that any fragment length supported by the sequences shown herein, in the tables, figures or Sequence Listing, may be used to describe a length over which percentage identity may be measured.

"Percent (%) amino acid sequence identity," with respect to the polypeptide sequences identified herein, is defined as the percentage of amino acid residues in a query sequence that are identical with the amino acid residues of a second, reference polypeptide sequence or a portion thereof, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve maximal alignment over the full length of the sequences being compared. Percent identity may be measured over the length of an entire defined polypeptide sequence, for example, as defined by a particular SEQ ID number, or may be measured over a shorter length, for example, over the length of a fragment taken from a larger, defined polypeptide sequence, for instance, a fragment of at least 15, at least 20, at least 30, at least 40, at least 50, at least 70 or at least 150 contiguous residues. Such lengths are exemplary only, and it is understood that any fragment length supported by the sequences shown herein, in the tables, figures or Sequence Listing, may be used to describe a length over which percentage identity may be measured.

The term "non-repetitiveness" as used herein in the context of a polypeptide refers to a lack or limited degree of internal homology in a peptide or polypeptide sequence. The term "substantially non-repetitive" can mean, for example, that there are few or no instances of four contiguous amino acids in the sequence that are identical amino acid types or that the polypeptide has a subsequence score (defined infra) of 10 or less or that there isn't a pattern in the order, from N- to C-terminus, of the sequence motifs that constitute the polypeptide sequence. The term "repetitiveness" as used herein in the context of a polypeptide refers to the degree of internal homology in a peptide or polypeptide sequence. In contrast, a "repetitive" sequence may contain multiple identical copies of short amino acid sequences. For instance, a polypeptide sequence of interest may be divided into n-mer sequences and the number of identical sequences can be counted. Highly repetitive sequences contain a large fraction of identical sequences while non-repetitive sequences contain few identical sequences. In the context of a polypeptide, a sequence can contain multiple copies of shorter sequences of defined or variable length, or motifs, in which the motifs themselves have non-repetitive sequences, rendering the full-length polypeptide substantially non-repetitive. The length of polypeptide within which the non-repetitiveness is measured can vary from 3 amino acids to about 200 amino acids, about from 6 to about 50 amino acids, or from about 9 to about 14 amino acids. "Repetitiveness" used in the context of polynucleotide sequences refers to the degree of internal homology in the sequence such as, for example, the frequency of identical nucleotide sequences of a given length. Repetitiveness can, for example, be measured by analyzing the frequency of identical sequences.

A "vector" is a nucleic acid molecule, preferably self-replicating in an appropriate host, which transfers an inserted nucleic acid molecule into and/or between host cells. The term includes vectors that function primarily for insertion of DNA or RNA into a cell, replication of vectors that function primarily for the replication of DNA or RNA, and expression vectors that function for transcription and/or translation of the DNA or RNA. Also included are vectors that provide more than one of the above functions. An "expression vector" is a polynucleotide which, when introduced into an appropriate host cell, can be transcribed and translated into a polypeptide(s). An "expression system" usually connotes a suitable host cell comprised of an expression vector that can function to yield a desired expression product.

"Serum degradation resistance," as applied to a polypeptide, refers to the ability of the polypeptides to withstand degradation in blood or components thereof, which typically involves proteases in the serum or plasma. The serum degradation resistance can be measured by combining the protein with human (or mouse, rat, monkey, as appropriate) serum or plasma, typically for a range of days (e.g. 0.25, 0.5, 1, 2, 4, 8, 16 days), typically at about 37° C. The samples for these time points can be run on a Western blot assay and the protein is detected with an antibody. The antibody can be to a tag in the protein. If the protein shows a single band on the western, where the protein's size is identical to that of the injected protein, then no degradation has occurred. In this exemplary method, the time point where 50% of the protein is degraded, as judged by Western blots or equivalent techniques, is the serum degradation half-life or "serum half-life" of the protein.

The term "$t_{1/2}$" as used herein means the terminal half-life calculated as $\ln(2)/K_{el}$. $K_{el}$ is the terminal elimination rate constant calculated by linear regression of the terminal linear portion of the log concentration vs. time curve. Half-life typically refers to the time required for half the quantity of an administered substance deposited in a living organism to be metabolized or eliminated by normal biological processes. The terms "$t_{1/2}$", "terminal half-life", "elimination half-life" and "circulating half-life" are used interchangeably herein.

"Apparent molecular weight factor" or "apparent molecular weight" are related terms referring to a measure of the relative increase or decrease in apparent molecular weight exhibited by a particular amino acid sequence. The apparent molecular weight factor is determined using size exclusion chromatography (SEC) and similar methods by comparing to globular protein standards and is measured in "apparent kD" units. The apparent molecular weight factor is the ratio between the apparent molecular weight factor and the actual molecular weight; the latter predicted by adding, based on amino acid composition, the calculated molecular weight of each type of amino acid in the composition.

The "hydrodynamic radius" or "Stokes radius" is the effective radius ($R_h$ in nm) of a molecule in a solution measured by assuming that it is a body moving through the solution and resisted by the solution's viscosity. In the embodiments of the invention, the hydrodynamic radius measurements of the XTEN fusion proteins correlate with the 'apparent molecular weight factor', which is a more intuitive measure. The "hydrodynamic radius" of a protein affects its rate of diffusion in aqueous solution as well as its ability to migrate in gels of macromolecules. The hydrodynamic radius of a protein is determined by its molecular weight as well as by its structure, including shape and compactness. Methods for determining the hydrodynamic radius are well known in the art, such as by the use of size exclusion chromatography (SEC), as described in U.S. Pat. Nos. 6,406,632 and 7,294,513. Most proteins have globular structure, which is the most compact three-dimensional structure a protein can have with the smallest hydrodynamic radius. Some proteins adopt a random and open, unstructured, or 'linear' conformation and as a result have a much larger hydrodynamic radius compared to typical globular proteins of similar molecular weight.

"Physiological conditions" refer to a set of conditions in a living host as well as in vitro conditions, including temperature, salt concentration, pH, that mimic those conditions of a living subject. A host of physiologically relevant conditions for use in in vitro assays have been established. Generally, a physiological buffer contains a physiological concentration of salt and is adjusted to a neutral pH ranging from about 6.5 to about 7.8, and preferably from about 7.0 to about 7.5. A variety of physiological buffers is listed in Sambrook et al. (1989). Physiologically relevant temperature ranges from about 25° C. to about 38° C., and preferably from about 35° C. to about 37° C.

A "reactive group" is a chemical structure that can be coupled to a second reactive group. Examples for reactive groups are amino groups, carboxyl groups, sulfhydryl groups, hydroxyl groups, aldehyde groups, azide groups. Some reactive groups can be activated to facilitate coupling with a second reactive group. Non-limiting examples for activation are the reaction of a carboxyl group with carbodiimide, the conversion of a carboxyl group into an activated ester, or the conversion of a carboxyl group into an azide function.

"Controlled release agent", "slow release agent", "depot formulation" or "sustained release agent" are used interchangeably to refer to an agent capable of extending the duration of release of a polypeptide of the invention relative to the duration of release when the polypeptide is administered in the absence of agent. Different embodiments of the present invention may have different release rates, resulting in different therapeutic amounts.

The terms "antigen", "target antigen" or "immunogen" are used interchangeably herein to refer to the structure or binding determinant that an antibody fragment or an antibody fragment-based therapeutic binds to or has specificity against.

The terms "specific binding" or "specifically bind" are used interchangeably herein to refer to the high degree of binding affinity of a targeting moiety or binding fusion protein to its corresponding target. Typically, specific binding as measured by one or more of the assays disclosed herein would have a dissociation constant or $K_d$ of less than about $10^{-6}$ M.

The term "payload" as used herein refers to a protein or peptide sequence that has biological or therapeutic activity; the counterpart to the pharmacophore of small molecules. Examples of payloads include, but are not limited to, cytokines, enzymes, hormones and blood and growth factors. Payloads can further comprise genetically fused or chemically conjugated moieties such as chemotherapeutic agents, antiviral compounds, toxins, or contrast agents. These conjugated moieties can be joined to the rest of the polypeptide via a linker which may be cleavable or non-cleavable.

The term "antagonist", as used herein, includes any molecule that partially or fully blocks, inhibits, or neutralizes a biological activity of a native polypeptide disclosed herein. Methods for identifying antagonists of a polypeptide may comprise contacting a native polypeptide with a candidate antagonist molecule and measuring a detectable change in one or more biological activities normally associated with the native polypeptide. In the context of the present invention, antagonists may include proteins, nucleic acids, carbohydrates, antibodies or any other molecules that decrease the effect of a biologically active protein.

The term "agonist" is used in the broadest sense and includes any molecule that mimics a biological activity of a native polypeptide disclosed herein. Suitable agonist molecules specifically include agonist antibodies or antibody fragments, fragments or amino acid sequence variants of native polypeptides, peptides, small organic molecules, etc. Methods for identifying agonists of a native polypeptide may comprise contacting a native polypeptide with a candidate agonist molecule and measuring a detectable change in one or more biological activities normally associated with the native polypeptide.

"Activity" for the purposes herein refers to an action or effect of a component of a fusion protein consistent with that of the corresponding native biologically active protein, wherein "biological activity" refers to an in vitro or in vivo biological function or effect, including but not limited to receptor binding, antagonist activity, agonist activity, or a cellular or physiologic response.

As used herein, "treatment" or "treating," or "palliating" or "ameliorating" is used interchangeably herein. These terms refer to an approach for obtaining beneficial or desired results including but not limited to a therapeutic benefit and/or a prophylactic benefit. By therapeutic benefit is meant eradication or amelioration of the underlying disorder being treated. Also, a therapeutic benefit is achieved with the eradication or amelioration of one or more of the physiological symptoms associated with the underlying disorder such that an improvement is observed in the subject, notwithstanding that the subject may still be afflicted with the underlying disorder. For prophylactic benefit, the compositions may be administered to a subject at risk of developing a particular disease, or to a subject reporting one or more of the physiological symptoms of a disease, even though a diagnosis of this disease may not have been made.

A "therapeutic effect", as used herein, refers to a physiologic effect, including but not limited to the cure, mitigation, amelioration, or prevention of disease in humans or other animals, or to otherwise enhance physical or mental wellbeing of humans or animals, caused by a fusion polypeptide of the invention other than the ability to induce the production of an antibody against an antigenic epitope possessed by the biologically active protein. Determination of a therapeutically effective amount is well within the capability of those skilled in the art, especially in light of the detailed disclosure provided herein.

The terms "therapeutically effective amount" and "therapeutically effective dose", as used herein, refers to an amount of a biologically active protein, either alone or as a part of a fusion protein composition, that is capable of having any detectable, beneficial effect on any symptom, aspect, measured parameter or characteristics of a disease state or condition when administered in one or repeated doses to a subject. Such effect need not be absolute to be beneficial.

The term "therapeutically effective dose regimen", as used herein, refers to a schedule for consecutively administered doses of a biologically active protein, either alone or as a part of a fusion protein composition, wherein the doses are given in therapeutically effective amounts to result in sustained beneficial effect on any symptom, aspect, measured parameter or characteristics of a disease state or condition.

I). General Techniques

The practice of the present invention employs, unless otherwise indicated, conventional techniques of immunology, biochemistry, chemistry, molecular biology, microbiology, cell biology, genomics and recombinant DNA, which are within the skill of the art. See Sambrook, J. et al., "Molecular Cloning: A Laboratory Manual," $3^{rd}$ edition, Cold Spring Harbor Laboratory Press, 2001; "Current protocols in molecular biology", F. M. Ausubel, et al. eds., 1987; the series "Methods in Enzymology," Academic Press, San Diego, Calif.; "PCR 2: a practical approach", M. J. MacPherson, B. D. Hames and G. R. Taylor eds., Oxford University Press, 1995; "Antibodies, a laboratory manual" Harlow, E. and Lane, D. eds., Cold Spring Harbor Laboratory, 1988; "Goodman & Gilman's The Pharmacological Basis of Therapeutics," $11^{th}$ Edition, McGraw-Hill, 2005; and Freshney, R. I., "Culture of Animal Cells: A Manual of Basic Technique," $4^{th}$ edition, John Wiley & Sons, Somerset, N.J., 2000, the contents of which are incorporated in their entirety herein by reference.

II). Binding Fusion Protein Compositions (a) The present invention relates, in part, to binding fusion protein ("BFP") compositions comprising fusion proteins of polypeptide targeting moieties linked to one or more extended recombinant polypeptides ("XTEN"). In particular, the invention provides isolated binding fusion protein compositions useful in the treatment of diseases, disorders or conditions in which the targeting moiety can be directed to an antigen, ligand, or receptor implicated in, associated with, or that modulates a disease, disorder or condition, while the XTEN carrier portion can be designed to confer a desired half-life or enhanced pharmaceutical property on the binding fusion protein, as described more fully below. The binding fusion proteins of the present invention may act as agonists or antagonists. In one embodiment, the composition can further comprise a second targeting moiety or multiple targeting moieties that can have binding affinity for the same or a different target, resulting in bispecific or multivalent binding fusion proteins. The invention provides several different forms and configurations of targeting moieties and XTEN. The binding fusion proteins of the embodiments disclosed herein exhibit one or more or any combination of the properties and/or the embodiments as detailed herein.

Targets

In general, the targeting moieties of the subject binding fusion protein compositions exhibit a binding specificity to a given target or another desired biological characteristic when used in vivo or when utilized in an in vitro assay. The subject binding fusion proteins comprising two or more targeting moieties can be designed to bind the same target, different epitopes on the same target, or different targets by the selective incorporation of targeting moieties with binding affinity to the respective binding sites.

The targets to which the targeting moieties of the subject binding fusion protein compositions can be directed include cytokines, cytokine-related proteins, cytokine receptors, chemokines, chemokines receptors, cell surface receptors or antigens, hormones or similar circulating proteins or peptides, oligonucleotides, or enzymatic substrates. The targets are generally associated with a disease, disorder or condition. As used herein, "a target associated with a disease, disorder or condition" means that the target is either expressed or over-expressed by disease cells or tissues, the target causes or is a mediator or is a by-product of the disease, disorder or condition, or the target is generally found in higher concentrations in a subject with the disease, disorder or condition, or the target is found in higher than baseline concentrations within or proximal to the areas of the disease, disorder or condition in the subject. A non-limiting example of the foregoing is the target HER2, which is implicated in approximately 30 percent of breast cancers due to an amplification of the HER2/neu gene or over-expression of its protein product. Over-expression of the HER2 receptor in breast cancer is associated with increased disease recurrence and worse prognosis, and a humanized anti-Her2/neu antibody is used in treatment of breast cancers expressing the HER2 receptor (see for example U.S. Pat. No. 4,753,894).

In one embodiment, the one or more targeting moieties can have binding affinity to targets selected from, but not limited to the targets of Table 1.

TABLE 1

Targets for targeting moieties
Target

ABCF1; ACVR1; ACVR1B; ACVR2; ACVR2B; ACVRL1; ADORA2A; Aggrecan; AGR2; AICDA; AIF1; AIG1; AKAP1; AKAP2; AMH; AMHR2; ANGPT1; ANGPT2; ANGPTL3; ANGPTL4; ANPEP; APC; APOC1; APRIL; AR; AZGP1 (zinc-a-glycoprotein); A4 integrin; B7; B7.1; B7.2; BAD; BAFF; BAG1; BAI1; BCL2; BCL6; BDNF; BLNK; BLR1 (MDR15); BlyS; BMP1; BMP2; BMP3B (GDF10); BMP4; BMP6; BMP8; BMPR1A; BMPR1B; BMPR2; BPAG1 (plectin); BRCA1; C19orf10 (IL27w); C3; C4A; C5; C5R1; CANT1; CASP1; CASP4; CAV1; CCBP2 (D6/JAB61); CCL1 (1-309); CCL11 (eotaxin); CCL13 (MCP-4); CCL15 (MIP-1d); CCL16 (HCC-4); CCL17 (TARC); CCL18 (PARC); CCL19 (MIP-3b); CCL2 (MCP-1); MCAF; CCL20 (MIP-3a); CCL21 (MIP-2); SLC; exodus-2; CCL22 (MDC/STC-1); CCL23 (MPIF-1); CCL24 (MPIF-2/eotaxin-2); CCL25 (TECK); CCL26 (eotaxin-3); CCL27 (CTACK/ILC); CCL28; CCL3 (MIP-1a); CCL4 (MIP-1b); CCL5 (RANTES); CCL7 (MCP-3); CCL8 (mcp-2); CCNA1; CCNA2; CCND1; CCNE1; CCNE2; CCR1 (CKR1/HM145); CCR2 (mcp-1RB/RA); CCR3 (CKR3/CMKBR3); CCR4; CCR5

TABLE 1-continued

Targets for targeting moieties
Target (CMKBR5/ChemR13); CCR6 (CMKBR6/CKR-L3/STRL22/DRY6); CCR7 (CKR7/EBI1); CCR8 (CMKBR8/TER1/CKR-L1); CCR9 (GPR-9-6); CCRL1 (VSHK1); CCRL2 (L-CCR); CD164; CD19; CD1C; CD20; CD200; CD-22; CD24; CD28; CD3; CD37; CD38; CD3E; CD3G; CD3Z; CD4; CD11a (LFA-1 integrin alphaL); CD40; CD40L; CD44; CD45RB; CD52; CD69; CD72; CD74; CD79A; CD79B; CD8; CD80; CD81; CD83; CD86; CD340; CDH1 (E-cadherin); CDH10; CDH12; CDH13; CDH18; CDH19; CDH20; CDH5; CDH7; CDH8; CDH9; CDK2; CDK3; CDK4; CDK5; CDK6; CDK7; CDK9; CDKN1A (p21Wap1/Cip1); CDKN1B (p27Kip1); CDKN1C; CDKN2A (p16INK4a); CDKN2B; CDKN2C; CDKN3; CEBPB; CER1; CHGA; CHGB; Chitinase; CHST10; CKLFSF2; CKLFSF3; CKLFSF4; CKLFSF5; CKLFSF6; CKLFSF7; CKLFSF8; CLDN3; CLDN7 (claudin-7); CLN3; CLU (clusterin); cMET; CMKLR1; CMKOR1 (RDC1); CNR1; COL18A1; COL1A1; COL4A3; COL6A1; CR2; CRP; CSF1 (M-CSF); CSF2 (GM-CSF); CSF3 (GCSF); CTLA4; CTNNB1 (b-catenin); CTSB (cathepsin B); CX3CL1 (SCYD1); CX3CR1 (V28); CXCL1 (GRO1); CXCL10(IP-10); CXCL11 (I-TAC/IP-9); CXCL12 (SDF1); CXCL13; CXCL14; CXCL16; CXCL2 (GRO2); CXCL3 (GRO3); CXCL5 (ENA-78/LIX); CXCL6 (GCP-2); CXCL9 (MIG); CXCR3 (GPR9/CKR-L2); CXCR4; CXCR6 (TYMSTR/STRL33/Bonzo); CYB5; CYC1; CYSLTR1; DAB2IP; DES; DKFZp451J0118; DNCL1; DPP4; E2F1; ECGF1; EDG1; EFNA1; EFNA3; EFNB2; EGF; EGFR; ELAC2; elastase; ENG; ENO1; ENO2; ENO3; EPHB4; EPO; ERBB-2 (Her2); EREG; ERK8; ESR1; ESR2; F3 (TF); FADD; FasL; FASN; FCER1A; FCER2; FCGR3A; FGF; FGF1 (aFGF); FGF10; FGF11; FGF12; FGF12B; FGF13; FGF14; FGF16; FGF17; FGF18; FGF19; FGF2 (bFGF); FGF20; FGF21; FGF22; FGF23; FGF3 (int-2); FGF4 (HST); FGF5; FGF6 (HST-2); FGF7 (KGF); FGF8; FGF9; FGFR3; FIGF (VEGFD); FIL1 (EPSILON); FIL1 (ZETA); FLJ12584; FLJ25530; FLRT1 (fibronectin); FLT1; FOS; FOSL1 (FRA-1); FY (DARC); GABRP (GABAa); GAGEB1; GAGEC1; GALNAC4S-6ST; GATA3; GDF5; GFI1; GGT1; GM-CSF; GNAS1; GNRH1; GPR2 (CCR10); GPR31; GPR44; GPR81 (FKSG80); GRCC10 (C10); GRP; GSN (Gelsolin); GSTP1; HAVCR2; HDAC4; HDAC5; HDAC7A; HDAC9; HER2; HGF; HIF1A; HIP1; histamine and histamine receptors; HLA-A; HLA-DRA; HM74; HMOX1; HUMCYT2A; ICEBERG; ICOSL; ID2; IFN-a; IFNA1; IFNA2; IFNA4; IFNA5; IFNA6; IFNA7; IFNB1; IFNgamma; IFNW1; IGBP1; IGF1; IGF1R; IGF2; IGFBP2; IGFBP3; IGFBP6; IL-1; IL10; IL10RA; IL10RB; IL11; IL11RA; IL-12; IL12A; IL12B; IL12RB1; IL12RB2; IL13; IL13RA1; IL13RA2; IL14; IL15; IL15RA; IL16; IL17; IL17B; IL17C; IL17R; IL18; IL18BP; IL18R1; IL18RAP; IL19; IL1A; IL1B; IL1F10; IL1F5; IL1F6; IL1F7; IL1F8; IL1F9; IL1HY1; IL1R1; IL1R2; IL1RAP; IL1RAPL1; IL1RAPL2; IL1RL1; IL1RL2; IL1RN; IL2; IL20; IL20RA; IL21R; IL22; IL22R; IL22RA2; IL23; IL24; IL25; IL26; IL27; IL28A; IL28B; IL29; IL2RA; IL2RB; IL2RG; IL3; IL30; IL3RA; IL4; IL4R; IL5; IL5RA; IL6; IL6R; IL6ST (glycoprotein 130); IL7; IL7R; IL8; IL8RA; IL8RB; IL8RB; IL9; IL9R; ILK; INHA; INHBA; INSL3; INSL4; IRAK1; IRAK2; ITGA1; ITGA2; ITGA3; ITGA6 (a6 integrin); ITGAV; ITGB3; ITGB4 (b 4 integrin); JAG1; JAK1; JAK3; JUN; K6HF; KAI1; KDR; KITLG; KLF5 (GC Box BP); KLF6; KLK10; KLK12; KLK13; KLK14; KLK15; KLK3; KLK4; KLK5; KLK6; KLK9; KRT1; KRT19 (Keratin 19); KRT2A; KRTHB6 (hair-specific type II keratin); LAMA5; LEP (leptin); LFA3; LIGHT; Lingo-p75; Lingo-Troy; LPS; LTA (TNF-b); LTB; LTB4R (GPR16); LTB4R2; LTBR; MACMARCKS; MAG or Omgp; MAP2K7 (c-Jun); MDK; MIB1; midkine; MIF; MIP-2; MKI67 (Ki-67); MMP2; MMP9; MS4A1; MSMB; MT3 (metallothionectin-III); MTSS1; MUC1 (mucin); MYC; MYD88; NCK2; neurocan; NFKB1; NFKB2; NGFB (NGF); NGFR; NgR-Lingo; NgR-Nogo66 (Nogo); NgR-p75; NgR-Troy; NME1 (NM23A); NOX5; NPPB; NROB1; NROB2; NR1D1; NR1D2; NR1H2; NR1H3; NR1H4; NRII2; NRII3; NR2C1; NR2C2; NR2E1; NR2E3; NR2F1; NR2F2; NR2F6; NR3C1; NR3C2; NR4A1; NR4A2; NR4A3; NR5A1; NR5A2; NR6A1; NRP1; NRP2; NT5E; NTN4; ODZ1; OPRD1; P2RX7; PAP; PART1; PATE; PAWR; PCA3; PCNA; PDGFA; PDGFB; PECAM1; PF4 (CXCL4); PGF; PGR; phosphacan; PIAS2; PIK3CG; PLAU (uPA); PLG; PLXDC1; PPBP (CXCL7); PPID; PR1; PRKCQ; PRKD1; PRL; PROC; PROK2; PSAP; PSCA; PTAFR; PTEN; PTGS2 (COX-2); PTN; RAC2 (p21Rac2); RANKL; RARB; RGS1; RGS13; RGS3; RNF110 (ZNF144); ROBO2; RSV; SI00A2; SCGB1D2 (lipophilin B); SCGB2A1 (mammaglobin 2); SCGB2A2 (mammaglobin 1); SCYE1 (endothelial Monocyte-activating cytokine); SDF2; SERPINA1; SERPINA3; SERPINB5 (maspin); SERPINE1 (PAI-1); SERPINF1; SHBG; SLA2; SLC2A2; SLC33A1; SLC43A1; SLIT2; SPP1; SPRR1B (Spr1); ST6GAL1; STAB1; STAT6; STEAP; STEAP2; TB4R2; TBX21; TCP10; TDGF1; TEK; TGFA; TGFB1; TGFB1I1; TGFB2; TGFB3; TGFBI; TGFBR1; TGFBR2; TGFBR3; TH1L; THBS1 (thrombospondin-1); THBS2; THBS4; THPO; TIE (Tie-1); TIMP3; tissue factor; TLR10; TLR2; TLR3; TLR4; TLR5; TLR6; TLR7; TLR8; TLR9; TNF; TNF-a; TNFAIP2 (B94); TNFAIP3; TNFRSF11A; TNFRSF1A; TNFRSF1B; TNFRSF21; TNFRSF5; TNFRSF6 (Fas); TNFRSF7; TNFRSF8; TNFRSF9; TNFSF10 (TRAIL); TNFSF11 (TRANCE); TNFSF12 (APO3L); TNFSF13 (April); TNFSF13B; TNFSF14 (HVEM-L); TNFSF15 (VEGI); TNFSF18; TNFSF4 (OX40 ligand); TNFSF5 (CD40 ligand); TNFSF6 (FasL); TNFSF7 (CD27 ligand); TNFSF8 (CD30 ligand); TNFSF9 (4-1BB ligand); TOLLIP; Toll-like receptors (TLR1, 2, 3, 4, 5, 6, 7, 8, 9, 10, 11, 12 to TLR-13); TOP2A (topoisomerase Iia); TP53; TPM1; TPM2; TRADD; TRAF1; TRAF2; TRAF3; TRAF4; TRAF5; TRAF6; TREM1; TREM2; TRPC6; TSLP; TWEAK; VAP1; VEGF; VEGFB; VEGFC; versican; VHL C5; VLA-1; VLA-4; XCL1 (lymphotactin); XCL2 (SCM-1b); XCR1 (GPR5/CCXCR1); YY1; ZFPM2.

In one embodiment, the one or more targeting moieties can have binding affinity to one or more tumor-associated antigens (TAA) known to be expressed on tumor or cancer cells or are otherwise associated with tumors or cancers. Tumor-associated antigens are known in the art, and are generally regarded as effective cellular targets for cancer diagnosis and therapy. In particular, researchers have sought to identify TAA that are specifically expressed on the surface of one or more particular types of cancer cell as compared to on one or more normal non-cancerous cells, and has given rise to the ability to specifically target cancer cells for destruction via antibody-based therapies. Non-limiting examples of TAA are listed in Table 2. In one embodiment, a binding fusion protein comprises a targeting moiety with binding affinity to a TAA target selected from Table 2. In another embodiment, the binding fusion protein comprises two or more targeting moieties that have binding affinity to one or more TAA targets selected from the targets of Table 2.

TABLE 2

Tumor-associated antigen targets

| TAA targets (synonyms) | Accession Number and References |
|---|---|
| Her2 (ErbB2) | GenBank accession no. M11730; U.S. Pat. No. 5,869,445; WO2004048938; WO2004027049; WO2004009622; WO2003081210; WO2003089904; WO2003016475; US2003118592; WO2003008537; WO2003055439; WO2003025228; WO200222636; WO200212341; WO200213847; WO200214503; WO200153463; WO200141787; WO200044899; WO200020579; WO9630514; EP1439393; WO2004043361; WO2004022709; WO200100244 |
| BMPR1B (bone morphogenetic protein receptor-type IB) | GenBank accession no. NM_001203; WO2004063362; WO2003042661; US 2003134790; WO2002102235; WO2003055443; WO200299122; WO2003029421; WO2003024392; WO200298358' WO200254940; WO200259377; WO200230268 |
| E16 (LAT1, SLC7A5) | GenBank accession no. NM_003486); WO2004048938; WO2004032842; WO2003042661; WO2003016475; WO200278524; WO200299074; WO200286443; WO2003003906; WO200264798; WO200014228; US2003224454; WO2003025138 |
| STEAP1 (six transmembrane epithelial antigen of prostate) | GenBank accession no. NM_012449; WO2004065577; WO2004027049; EP1394274; WO2004016225; WO2003042661; US2003157089; US2003185830; US2003064397; WO200289747618; WO2003022995 |
| STEAP2 (six transmembrane epithelial antigen of prostate 2) | GenBank accession no. AF455138; WO2003087306; US2003064397; WO200272596; WO200172962; WO2003104270; WO2003104270; US2004005598; WO2003042661; US2003060612; WO200226822; WO200216429 |
| CA125/0772P (MUC16) | GenBank accession no. AF361486; WO2004045553; WO200292836; WO200283866; US2003124140 |
| megakaryocyte potentiating factor (MPF, mesothelin) | GenBank accession no. NM_005823; WO2003101283; WO2002102235; WO2002101075; WO200271928; WO9410312 |
| Na/Pi cotransporter type IIb (NaPi3b) | GenBank accession no. NM_006424; WO2004022778; EP1394274; WO2002102235; EP875569; WO200157188; WO2004032842; WO200175177 |
| Semaphorin 5b (SEMA5B, SEMAG) | GenBank accession no. AB040878; WO2004000997; WO2003003984; WO200206339; WO200188133; WO2003054152; WO2003101400 |
| Prostate cancer stem cell antigen (PSCA hlg) | GenBank accession no. AY358628; US2003129192; US2004044180; US2004044179; US2003096961; US2003232056; WO2003105758; US2003206918; EP1347046; WO2003025148 |
| ETBR (Endothelin type B receptor) | GenBank accession no. AY275463; WO2004045516; WO2004048938; WO2004040000; WO2003087768; WO2003016475; WO2003016475; WO200261087; WO2003016494; WO2003025138; WO200198351; EP522868; WO200177172; US2003109676; U.S. Pat. No. 6,518,404; U.S. Pat. No. 5,773,223; WO2004001004 |
| TRPV4 (Transient receptor potential cation channel, subfamily V) | U.S. patent application No. 20090208514 |
| CDC45L | GenBank Accession NO. AJ223728; U.S. patent application No. 20090208514 |
| CRIPTO (CR, CR1, CRGF) | GenBank accession no. NP_003203 or NM_003212; US2003224411; WO2003083041; WO2003034984; WO200288170; WO2003024392; WO200216413; WO200222808; U.S. Pat. No. 5,854,399; U.S. Pat. No. 5,792,616 |
| CD21 (CR2 (Complement receptor 2) or C3DR (C3d/Epstein Barr virus receptor) | GenBank accession no. M26004; WO2004045520; US2004005538; WO2003062401; WO2004045520; WO9102536; WO2004020595 |
| CD79b (CD79B, CD79β, IGb (immunoglobulin-associated beta), B29) | GenBank accession no. NM_000626 or 11038674; WO2004016225; WO2003087768; US2004101874; WO2003062401; WO200278524; US2002150573; U.S. Pat. No. 5,644,033; WO2003048202; WO 99/558658, U.S. Pat. No. 6,534,482; WO200055351 |
| FcRH2 (IFGP4, IRTA4, SPAP1A (SH2 domain containing phosphatase anchor protein 1a), SPAP1B, SPAP1C) | GenBank accession no. NM_030764, AY358130; WO2004016225; WO2003077836; WO200138490; WO2003097803; WO2003089624 |
| NCA (CEACAM6) | GenBank accession no. M18728; WO2004063709; EP1439393; WO2004044178; WO2004031238; WO2003042661; WO200278524; WO200286443; WO200260317 |

TABLE 2-continued

Tumor-associated antigen targets

| TAA targets (synonyms) | Accession Number and References |
| --- | --- |
| MDP (DPEP1) | GenBank accession no. BC017023; WO2003016475; WO200264798 |
| IL20Rα (IL20Ra, ZCYTOR7) | GenBank accession no. AF184971; EP1394274; US2004005320; WO2003029262; WO2003002717; WO200222153; US2002042366; WO200146261; WO200146232; WO9837193 |
| BECAN (Brevican core protein) | GenBank accession no. AF229053; US2003186372; US2003186373; US2003119131; US2003119122; US2003119126; US2003119121; US2003119129; US2003119130; US2003119128; US2003119125; WO2003016475; WO200202634 |
| EphB2R (DRT, ERK, Hek5, EPHT3, Tyro5) | GenBank accession no. NM_004442; WO2003042661; WO200053216; WO2004065576 (Claim 1); WO2004020583; WO2003004529; WO200053216 |
| B7h (ASLG659) | GenBank accession no. AX092328; US20040101899; WO2003104399; WO2004000221; US2003165504; US2003124140; US2003065143; WO2002102235; US2003091580; WO200210187; WO200194641; WO200202624; US2002034749; WO200206317; WO200271928; WO200202587; WO200140269; WO200036107; WO2004053079; WO2003004989; WO200271928 |
| PSCA (Prostate stem cell antigen precursor | GenBank accession no. AJ297436; WO2004022709; EP1394274; US2004018553; WO2003008537 (Claim 1); WO200281646; WO2003003906; WO200140309; US2001055751; WO200032752; WO9851805; WO9851824; WO9840403 |
| BAFF-R (B cell-activating factor receptor, BLyS receptor 3, BR3) | GenBank accession No. AF116456; WO2004058309; WO2004011611; WO2003045422; WO2003014294; WO2003035846; WO200294852; WO200238766; WO200224909 |
| CD22 (B-cell receptor CD22-β-form, BL-CAM, Lyb-8, Lyb8, SIGLEC-2, FLJ22814) | GenBank accession No. AK026467; WO2003072036 |
| CD79a (immunoglobulin-associated alpha) | GenBank accession No. NP_001774.10; WO2003088808, US20030228319; WO2003062401; US2002150573; WO9958658; WO9207574; U.S. Pat. No. 5,644,033 |
| CXCR5 (Burkitt's lymphoma receptor 1) | GenBank accession No. NP_001707.1; WO2004040000; WO2004015426; US2003105292; U.S. Pat. No. 6,555,339; WO200261087; WO200157188; WO200172830; WO200022129; WO9928468; U.S. Pat. No. 5,440,021; WO9428931; WO9217497 |
| HLA-DOB | GenBank accession No. NP_002111.1; WO9958658; U.S. Pat. No. 6,153,408; U.S. Pat. No. 5,976,551; U.S. Pat. No. 6,011,146 |
| P2X5 | GenBank accession No. NP_002552.2; WO2004047749; WO2003072035; WO200222660; WO2003093444; WO2003087768; WO2003029277 |
| CD72 (B-cell differentiation antigen CD72, Lyb-2) | GenBank accession No. NP_001773.1; WO2004042346; WO2003026493; WO200075655 |
| CD180 (LY64) | GenBank accession No. NP_005573.1; US2002193567; WO9707198; WO2003083047; WO9744452 |
| FcRH1 (Fc receptor-like protein 1) | GenBank accession No. NP_443170.1) WO2003077836; WO200138490; WO2003089624; EP1347046; WO2003089624 |
| IRTA2 (Immunoglobulin superfamily receptor translocation associated 2) | GenBank accession No. Human: AF343662, AF343663, AF343664, AF343665, AF369794, AF397453; WO2003024392; WO2003077836; WO200138490 |
| TENB2 (TMEFF2, tomoregulin, TPEF, HPP1) | GenBank accession No. AF179274; AY358907, CAF85723, CQ782436; WO2004074320; WO2003042661; WO2003009814; EP1295944; WO200230268; WO200190304; US2004249130; US2004022727; WO2004063355; US2004197325; US2003232350; US2004005563; US2003124579 |
| CS1 (CRACC, 19A, APEX-1, FOAP12) | GenBank Accession No. NM 021181; US 20100168397 |
| DLL4 | GenBank Accession No. NM 019074; US 20100303812 |
| Lewis Y | ADB235860; U.S. Pat. No. 7,879,983 |
| CD40 (Bp50, CDW40, MGC9013, TNFRSF5, p50) | AL035662.65; U.S. Pat. No. 6,946,129 |
| OBA1 (5T4) | GenBank Accession No. NP_001159864.1; US 20100021483 |
| p97 | Woodbury et al., 1980, Proc. Natl. Acad. Sci. USA 77: 2183-2186; Brown et al., 1981, J. Immunol. 127: 539-546 |

TABLE 2-continued

Tumor-associated antigen targets

| TAA targets (synonyms) | Accession Number and References |
| --- | --- |
| carcinoembryonic antigen (CEA) | GenBank Accession No. NP_004354.2; U.S. Pat. No. 6,676,924 |
| TAG-72 | U.S. Pat. No. 7,256,004 |
| DNA | |
| Neuropilin-1 (NRP1) | GenBank Accession No. NP_001019799.1; US 20080213268 |
| A33 | GenBank Accession No. NP_005805.1; U.S. Pat. No. 7,579,187 |
| Mucin-1 (MUC1) | GenBank Accession No. NP_001018016.1; NP_001018017.1; U.S. Pat. No. 7,183,388 |
| ED-B fibronectin | U.S. Pat. No. 7,785,591 |
| Thomsen-Friedenreich antigen (TF) | U.S. Pat. No. 7,374,755; US 20100297159 |

(b) Extended Recombinant Polypeptides

In one aspect, the invention provides XTEN polypeptide compositions that are useful as a fusion protein partner to which one or more targeting moieties can be linked, resulting in a binding fusion protein. XTEN are generally extended length polypeptides with non-naturally occurring, substantially non-repetitive sequences that are composed mainly of small hydrophilic amino acids, with the sequence having a low degree or no secondary or tertiary structure under physiologic conditions. XTEN have utility as fusion protein partners in that they serve in various roles, conferring certain desirable pharmacokinetic, physicochemical and pharmaceutical properties, amongst other properties described below, when linked to a targeting moiety to a create a fusion protein.

In some embodiments, XTEN are long polypeptides having greater than 100 to about 3000 residues, and preferably 400 to about 3000 residues when used as a carrier or cumulatively when more than one XTEN unit is used in a single fusion protein with a targeting moiety; e.g., a linker and a carrier or an N-terminal XTEN and a carrier. In other embodiments, shorter XTEN sequences can be used as linkers to join components of the binding fusion proteins or to enhance expression as an N-terminal XTEN, as described more fully below.

The selection criteria for the XTEN used to create the inventive compositions generally relate to attributes of physical/chemical properties and conformational structure of the XTEN that can be, in turn, used to confer enhanced pharmaceutical and pharmacokinetic properties to the compositions. The XTEN of the present invention may exhibit one or more of the following advantageous properties: conformational flexibility, enhanced aqueous solubility, high degree of protease resistance, low immunogenicity, low binding to mammalian receptors, and increased hydrodynamic (or Stokes) radii; properties that can make them particularly useful as fusion protein partners and scaffolds for drug conjugates. Non-limiting examples of the properties of the inventive compositions that may be enhanced by XTEN include increases in the overall solubility and/or metabolic stability, reduced susceptibility to proteolysis, reduced immunogenicity, reduced rate of absorption when administered subcutaneously or intramuscularly, and enhanced pharmacokinetic properties such as longer terminal half-life and increased area under the curve (AUC), slower absorption after subcutaneous or intramuscular injection (compared to agents not linked to XTEN administered by a parenteral route) such that the $C_{max}$ is lower, which may, in turn, result in reductions in adverse effects that, collectively, can result in an increased period of time that a fusion protein composition administered to a subject retains therapeutic activity.

A variety of methods and assays are known in the art for determining the physical/chemical properties of proteins such as the compositions comprising the inventive XTEN; properties such as secondary or tertiary structure, solubility, protein aggregation, melting properties, contamination and water content. Such methods include analytical centrifugation, EPR, HPLC-ion exchange, HPLC-size exclusion, HPLC-reverse phase, light scattering, capillary electrophoresis, circular dichroism, differential scanning calorimetry, fluorescence, HPLC-ion exchange, HPLC-size exclusion, IR, NMR, Raman spectroscopy, refractometry, and UV/Visible spectroscopy. Additional methods are disclosed in Arnau et al, Prot Expr and Purif (2006) 48, 1-13. Application of these methods to the invention would be within the grasp of a person skilled in the art.

In one embodiment, XTEN are designed to behave like denatured peptide sequences under physiological conditions, despite the extended length of the polymer. Denatured describes the state of a peptide in solution that is characterized by a large conformational freedom of the peptide backbone. Most peptides and proteins adopt a denatured conformation in the presence of high concentrations of denaturants or at elevated temperature. Peptides in denatured conformation have, for example, characteristic circular dichroism (CD) spectra and are characterized by a lack of long-range interactions as determined by NMR. "Denatured conformation" and "unstructured conformation" are used synonymously herein. In one embodiment, the invention provides XTEN sequences that, under physiologic conditions, can resemble denatured sequences largely devoid in secondary structure. In one embodiment, the XTEN sequences can be substantially devoid of secondary structure under physiologic conditions. "Largely devoid," as used in this context, means that less than 50% of the XTEN amino acid residues of the XTEN sequence contribute to secondary structure as measured or determined by the means described herein. "Substantially devoid," as used in this context, means that at least about 60%, or about 70%, or about 80%, or about 90%, or about 95%, or at least about 99% of the XTEN amino acid residues of the XTEN sequence do not contribute to secondary structure, as measured or determined by the means described herein.

A variety of methods have been established in the art to discern the presence or absence of secondary and tertiary structures in a given polypeptide. In particular, secondary structure can be measured spectrophotometrically, e.g., by circular dichroism spectroscopy in the "far-UV" spectral region (190-250 nm). Secondary structure elements, such as alpha-helix and beta-sheet, each give rise to a characteristic shape and magnitude of CD spectra. Secondary structure can also be predicted for a polypeptide sequence via certain computer programs or algorithms, such as the well-known Chou- Fasman algorithm (Chou, P. Y., et al. (1974) *Biochemistry*, 13: 222-45) and the Garnier-Osguthorpe-Robson ("GOR") algorithm (Garnier J, Gibrat J F, Robson B. (1996), GOR method for predicting protein secondary structure from amino acid sequence. Methods Enzymol 266:540-553), as described in US Patent Application Publication No. 20030228309A1. For a given sequence, the algorithms can predict whether there exists some or no secondary structure at all, expressed as the total and/or percentage of residues of the sequence that form, for example, alpha-helices or beta-sheets or the percentage of residues of the sequence predicted to result in random coil formation (which lacks secondary structure).

In one embodiment, the XTEN sequences used in the subject fusion protein compositions have an alpha-helix percentage ranging from 0% to less than about 5% as determined by the Chou-Fasman algorithm. In another embodiment, the XTEN sequences of the fusion protein compositions have a beta-sheet percentage ranging from 0% to less than about 5% as determined by the Chou-Fasman algorithm. In some embodiments, the XTEN sequences of the fusion protein compositions have an alpha-helix percentage ranging from 0% to less than about 5% and a beta-sheet percentage ranging from 0% to less than about 5% as determined by the Chou-Fasman algorithm. In one embodiment, the XTEN sequences of the fusion protein compositions have an alpha-helix percentage less than about 2% and a beta-sheet percentage less than about 2%. The XTEN sequences of the fusion protein compositions have a high degree of random coil percentage, as determined by the GOR algorithm. In some embodiments, an XTEN sequence have at least about 80%, more preferably at least about 90%, more preferably at least about 91%, more preferably at least about 92%, more preferably at least about 93%, more preferably at least about 94%, more preferably at least about 95%, more preferably at least about 96%, more preferably at least about 97%, more preferably at least about 98%, and most preferably at least about 99% random coil, as determined by the GOR algorithm. In one embodiment, the XTEN sequences of the fusion protein compositions have an alpha-helix percentage ranging from 0% to less than about 5% and a beta-sheet percentage ranging from 0% to less than about 5% as determined by the Chou-Fasman algorithm and at least about 90% random coil, as determined by the GOR algorithm. In another embodiment, the XTEN sequences of the fusion protein compositions have an alpha-helix percentage less than about 2% and a beta-sheet percentage less than about 2% at least about 90% random coil, as determined by the GOR algorithm.

1. Non-Repetitive Sequences

It is specifically contemplated that the XTEN sequences of the binding fusion protein embodiments are substantially non-repetitive. In general, repetitive amino acid sequences have a tendency to aggregate or form higher order structures, as exemplified by natural repetitive sequences such as collagens and leucine zippers. These repetitive amino acids may also tend to form contacts resulting in crystalline or pseudocrystalline structures. In contrast, the low tendency of non-repetitive sequences to aggregate enables the design of long-sequence XTENs with a relatively low frequency of charged amino acids that would otherwise be likely to aggregate if the sequences were repetitive. In one embodiment, the XTEN sequences have greater than about 36 to about 1000 amino acid residues, or greater than about 100 to about 3000 amino acid residues in which no three contiguous amino acids in the sequence are identical amino acid types unless the amino acid is serine, in which case no more than three contiguous amino acids are serine residues. In the foregoing embodiment, the XTEN sequence is "substantially non-repetitive." In another embodiment, as described more fully below, the XTEN sequences of the compositions comprise non-overlapping sequence motifs of 9 to 14 amino acid residues wherein the motifs consist of 4 to 6 types of amino acids selected from glycine (G), alanine (A), serine (S), threonine (T), glutamate (E) and proline (P), and wherein the sequence of any two contiguous amino acid residues in any one motif is not repeated more than twice in the sequence motif. In the foregoing embodiment, the XTEN sequence is "substantially non-repetitive."

Figure 37:
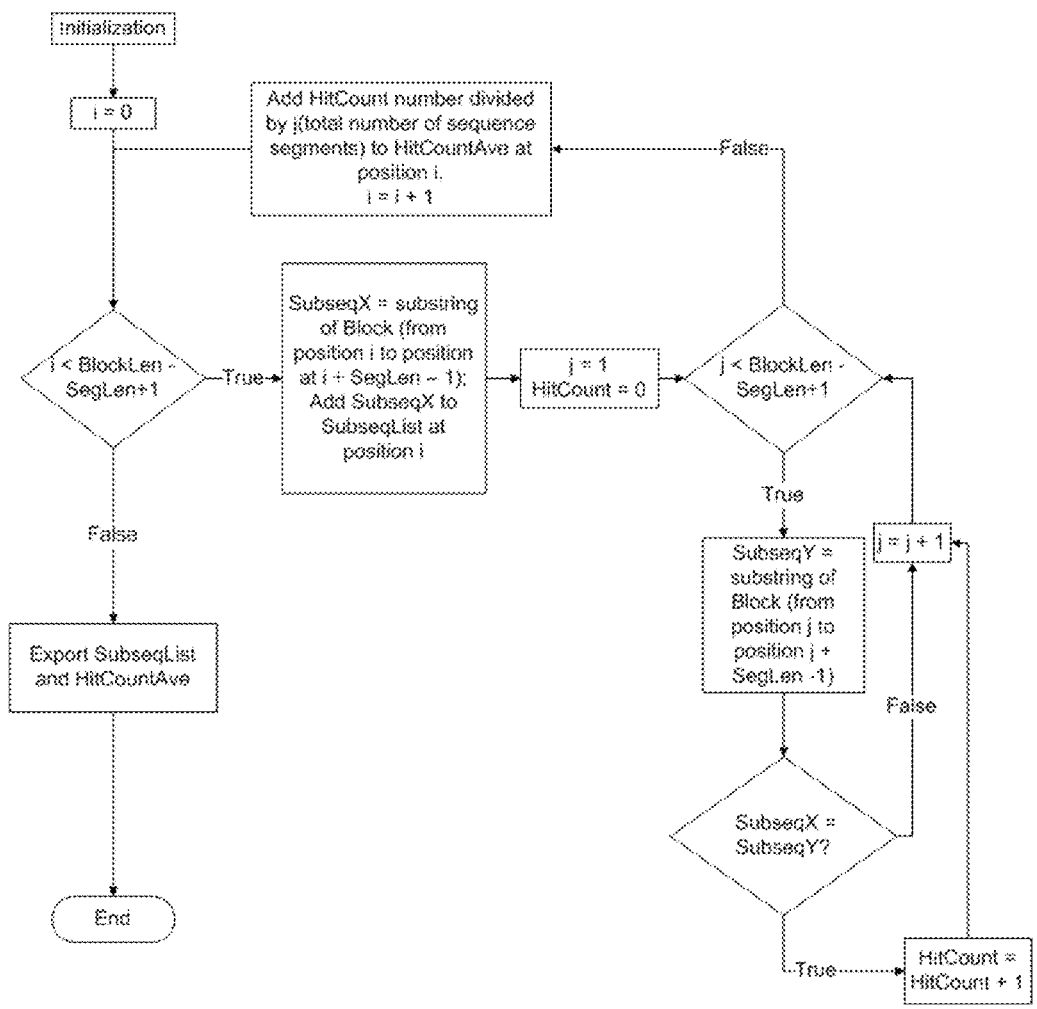
FIG. 37 is a schematic of the logic flow chart of the algorithm SegScore. In the figure the following legend applies: i, j—counters used in the control loops that run through the entire sequence; HitCount—this variable is a counter that keeps track of how many times a subsequence encounters an identical subsequence in a block; SubSeqX—this variable holds the subsequence that is being checked for redundancy; SubSeqY—this variable holds the subsequence that the SubSeqX is checked against; BlockLen—this variable holds the user determined length of the block; SegLen—this variable holds the length of a segment. The program is hardcoded to generate scores for subsequences of lengths 3, 4, 5, 6, 7, 8, 9, and 10; Block—this variable holds a string of length BlockLen. The string is composed of letters from an input XTEN sequence and is determined by the position of the i counter; SubSeqList—this is a list that holds all of the generated subsequence scores.
Figure 38:
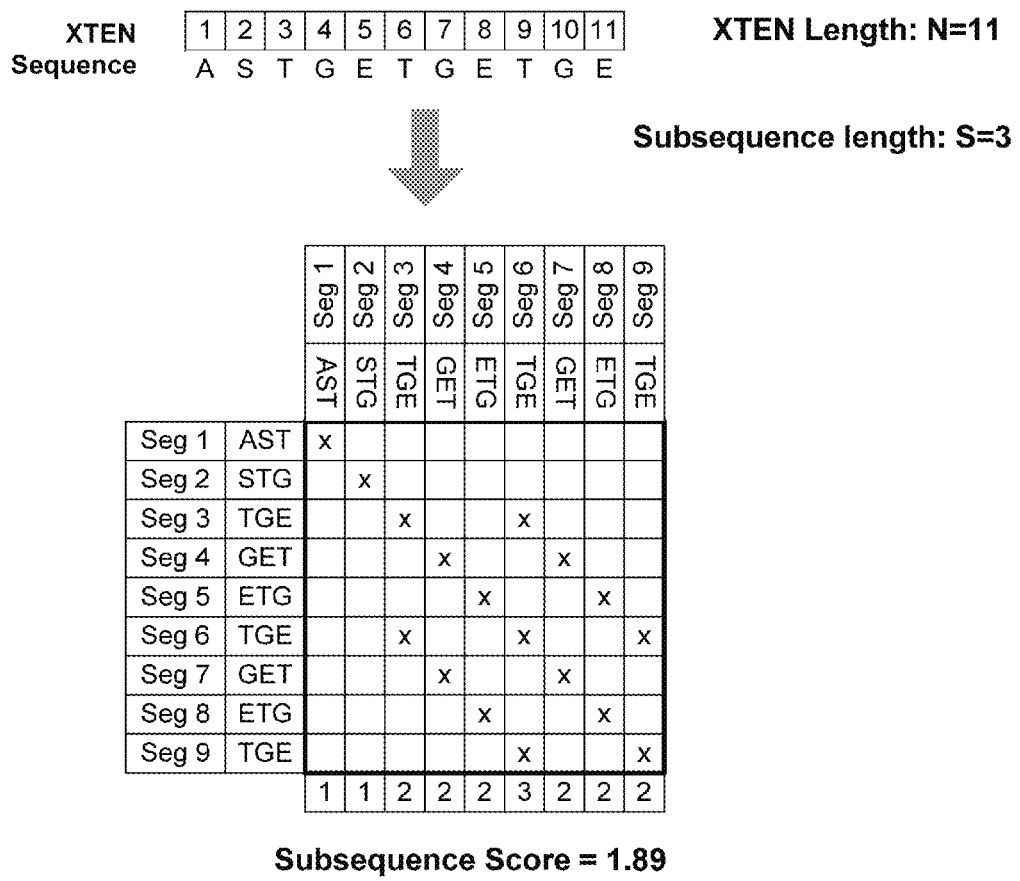
FIG. 38 depicts the application of the algorithm SegScore to a hypothetical XTEN of 11 amino acids in order to determine the repetitiveness. An XTEN sequence (SEQ ID NO: 869) consisting of N amino acids is divided into N−S+1 subsequences of length S(S=3 in this case). A pair-wise comparison of all subsequences is performed and the average number of identical subsequences is calculated to result, in this case, in a subsequence score of 1.89.
Figure 40A:
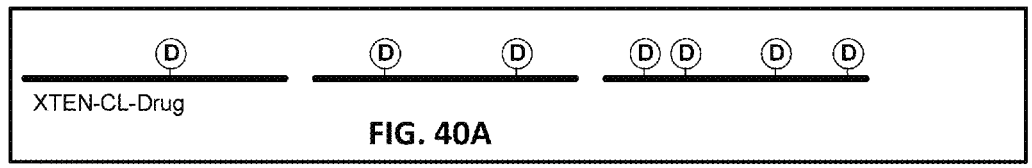
FIG. 40A shows three XTEN-drug conjugates, with 1, 2 and 4 drug molecules conjugated to the XTEN.
Figure 40B:
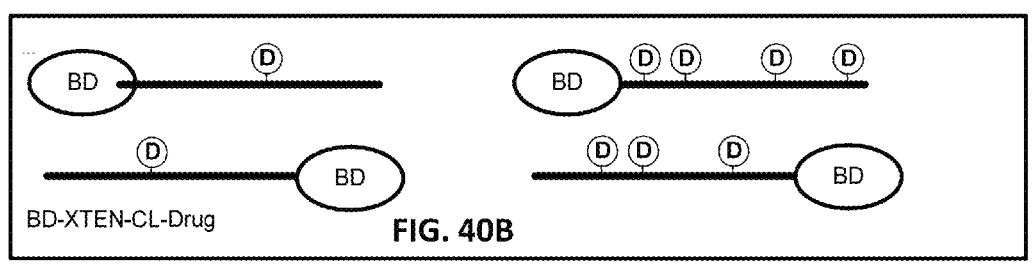
FIG. 40B shows four configurations of BFP-D with the binding domain ("BD") linked to the N- or C-terminus of XTEN of the fusion protein and either 1, 3 or 4 drug molecules conjugated to the XTEN carrier by cross-linkers.
Figure 40C:
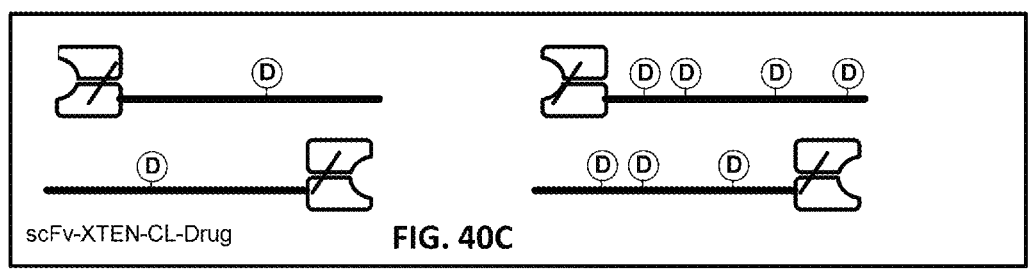
FIG. 40C shows four configurations of BFP-D with the scFv binding domain on the N- or C-terminus of the XTEN and either 1, 3 or 4 drug molecules conjugated to the XTEN carrier by cross-linkers.
Figure 40D:
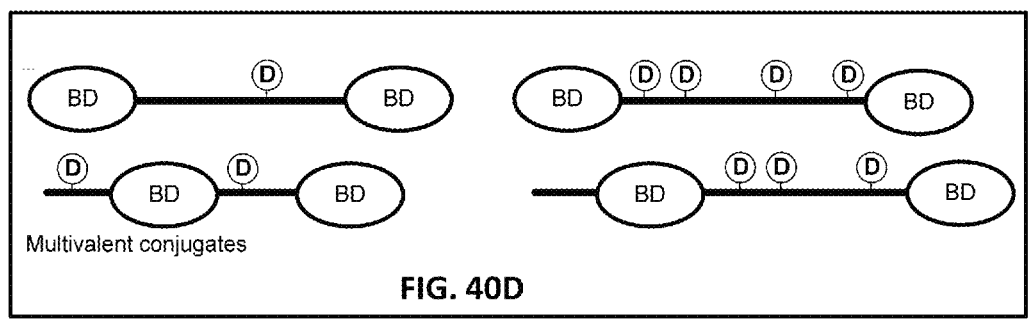
FIG. 40D shows four configurations of multivalent BFP-D with two binding domains ("BD") on the N- or C-terminus or configurations with an N-terminal XTEN and either 1, 2, 3 or 4 drug molecules conjugated to the XTEN carrier or N-terminal XTEN by cross-linkers.
Figure 41A:
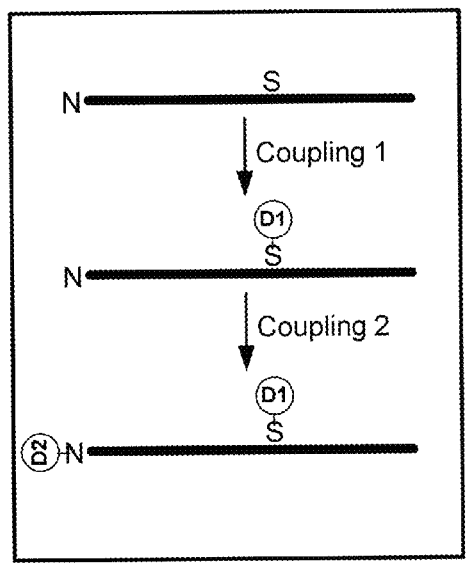
FIG. 41A shows a two-step process of coupling of one drug-crosslinker ligand (D1) to an internal cysteine of a cysteine-engineered XTEN and a second, different drug-crosslinker ligand (D2) to the N-terminus of XTEN.
Figure 41B:
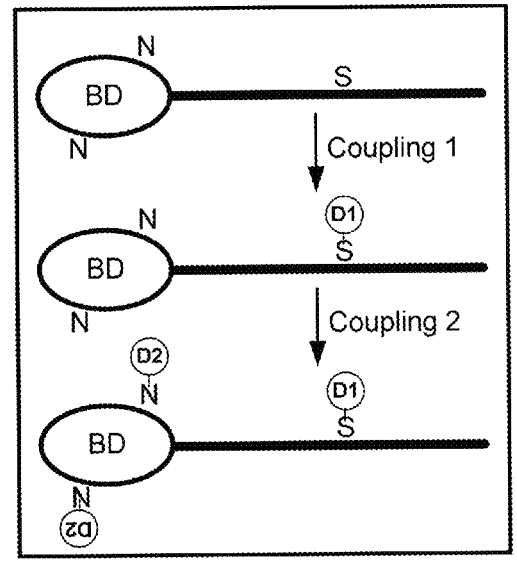
FIG. 41B shows a two-step process of coupling of one ligand to an internal cysteine cysteine-engineered XTEN and two ligands to amino groups in a recombinant binding domain (BD).
Figure 41C:
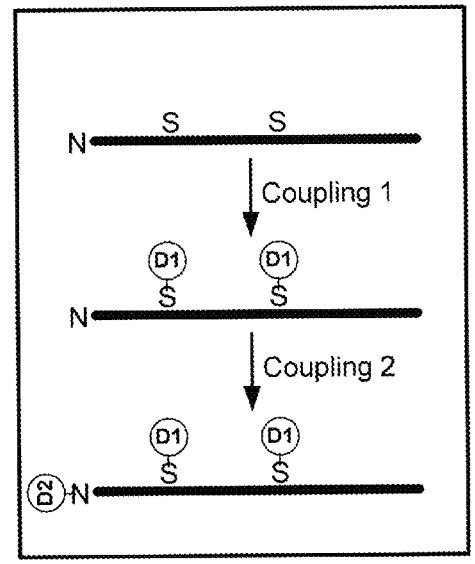
FIG. 41C shows a two-step process of coupling of two drug ligands (D1) to two internal cysteine of a cysteine-engineered XTEN and a second drug ligand (D2) to the N-terminus of XTEN.
Figure 41D:
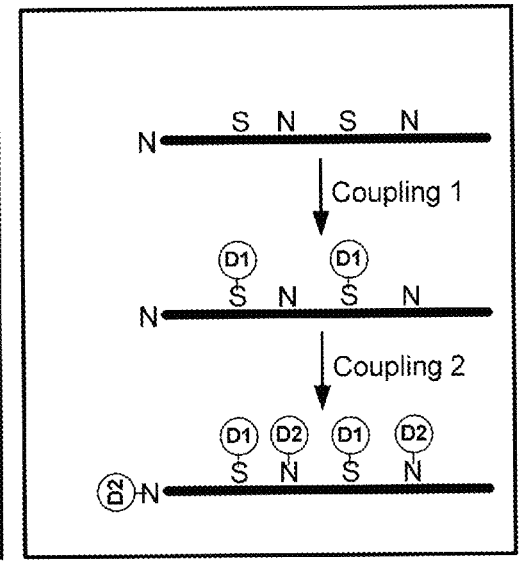
FIG. 41D shows a two-step process of coupling two drug ligands (D1) to XTEN internal cysteines and 1 drug-crosslinker ligand (D2) to the N-terminus and two additional D2 drug-crosslinker ligands to internal lysine residues of the engineered XTEN.

The degree of repetitiveness of a polypeptide or a gene can be measured by computer programs or algorithms or by other means known in the art. According to the current invention, algorithms to be used in calculating the degree of repetitiveness of a particular polypeptide, such as an XTEN, are disclosed herein, and examples of sequences analyzed by algorithms are provided (see Examples, below). In one embodiment, the repetitiveness of a polypeptide of a predetermined length can be calculated (hereinafter "subsequence score") according to the formula given by Equation I:

$$\text{Subsequence score} = \frac{\sum_{i=1}^{m} Count_i}{m} \quad \text{I}$$

wherein:
  m=(amino acid length of polypeptide)−(amino acid length of subsequence)+1; and
  $Count_i$=cumulative number of occurrences of each unique subsequence within $sequence_i$ An algorithm termed "SegScore" was developed to apply the foregoing equation to quantitate repetitiveness of polypeptides, such as an XTEN, providing the subsequence score wherein sequences of a predetermined amino acid length are analyzed for repetitiveness by determining the number of times (a "count") a unique subsequence of length "s" appears in the set length, divided by the absolute number of subsequences within the predetermined length of the sequence. FIG. 37 depicts a logic flowchart of the SegScore algorithm, while FIG. 38 portrays a schematic of how a subsequence score is derived for a fictitious XTEN with 11 amino acids and a subsequence length of 3 amino acid residues. For example, a predetermined polypeptide length of 200 amino acid residues has 192 overlapping 9-amino acid subsequences and 198 3-mer subsequences, but the subsequence score of any given polypeptide will depend on the absolute number of unique subsequences and how frequently each unique subsequence (meaning a different amino acid sequence) appears in the predetermined length of the sequence. In the context of the present invention wherein the algorithm is used to determine the degree of repetitiveness in a polypeptide, the variable "amino acid length of polypeptide" is set to 200 amino acids and the variable "amino acid length of subsequence" is set to 3 amino acids. Thus, the subsequence score will equal the sum of occurrences of each unique 3-mer frame across a 200 consecutive amino acid sequence of the polypeptide divided by the absolute number of unique 3-mer subsequences within the 200 amino acid sequence. Examples of such subsequence scores derived from the first 200 amino acids of repetitive and non-repetitive polypeptides are presented in Example 58.

In one embodiment, the present invention provides binding fusion proteins comprising one XTEN in which the XTEN has a subsequence score of less than 10, or less than 9, or less than 8, or less than 7, or less than 6, or less than 5, or less. In another embodiment, the invention provides binding fusion proteins comprising two more XTEN in which at least one XTEN has a subsequence score of less than 10, or less than 9, or less than 8, or less than 7, or less than 6, or less than 5, or less. In yet another embodiment, the invention provides binding fusion proteins comprising at least two XTEN in which each individual XTEN of 36 or more amino acids has a subsequence score of less than 10, or less than 9, or less than 8, or less than 7, or less than 6, or less than 5, or less. In the embodiments of this paragraph, the XTEN is characterized as "substantially non-repetitive.".

It is believed that the non-repetitive characteristic of XTEN of the present invention contributes to many of the enhanced physicochemical and biological properties of the binding fusion proteins; either solely or in conjunction with the choice of the particular types of amino acids that predominate in the XTEN of the compositions disclosed herein. These properties include a higher degree of expression of the fusion protein in the host cell, greater genetic stability of the gene encoding XTEN, and a greater degree of solubility and less tendency to aggregate of the resulting binding fusion proteins compared to fusion proteins comprising polypeptides having repetitive sequences. These properties permit more efficient manufacturing, lower cost of goods, and facilitate the formulation of XTEN-comprising pharmaceutical preparations containing extremely high drug concentrations, in some cases exceeding 100 mg/ml. Furthermore, the XTEN polypeptide sequences of the embodiments are designed to have a low degree of internal repetitiveness in order to reduce or substantially eliminate immunogenicity when administered to a mammal. Polypeptide sequences composed of short, repeated motifs largely limited to only three amino acids, such as glycine, serine and glutamate, may result in relatively high antibody titers when administered to a mammal despite the absence of predicted T-cell epitopes in these sequences. This may be caused by the repetitive nature of polypeptides, as it has been shown that immunogens with repeated epitopes, including protein aggregates, cross-linked immunogens, and repetitive carbohydrates are highly immunogenic and can, for example, result in the cross-linking of B-cell receptors causing B-cell activation. (Johansson, J., et al. (2007) Vaccine, 25:1676-82; Yankai, Z., et al. (2006) Biochem Biophys Res Commun, 345:1365-71; Hsu, C. T., et al. (2000) Cancer Res, 60:3701-5); Bachmann M F, et al. Eur J Immunol (1995) 25(12):3445-3451).

2. Exemplary Sequence Motifs

The present invention encompasses XTEN used as fusion partners that comprise multiple units of shorter sequences, or motifs, in which the amino acid sequences of the motifs are non-repetitive. The non-repetitive property is met despite the use of a "building block" approach using a library of sequence motifs that are multimerized to create the XTEN sequences. Thus, while an XTEN sequence may consist of multiple units of as few as four different types of sequence motifs, because the motifs themselves generally consist of non-repetitive amino acid sequences, the overall XTEN sequence is designed to render the sequence substantially non-repetitive.

In one embodiment, XTEN have a non-repetitive sequence of greater than about 36 to about 3000 amino acid residues wherein at least about 80%, or at least about 85%, or at least about 90%, or at least about 95%, or at least about 97%, or about 100% of the XTEN sequence consists of non-overlapping sequence motifs, wherein each of the motifs has about 9 to 36 amino acid residues. In other embodiments, at least about 80%, or at least about 85%, or at least about 90%, or at least about 95%, or at least about 97%, or about 100% of the XTEN sequence consists of non-overlapping sequence motifs wherein each of the motifs has 9 to 14 amino acid residues. In still other embodiments, at least about 80%, or at least about 85%, or at least about 90%, or at least about 95%, or at least about 97%, or about 100% of the XTEN sequence component consists of non-overlapping sequence motifs wherein each of the motifs has 12 amino acid residues. In these embodiments, it is preferred that the sequence motifs be composed mainly or exclusively of small hydrophilic amino acids, such that the overall sequence has an unstructured, flexible characteristic. Examples of amino acids that are included in XTEN are, e.g., arginine, lysine, threonine, alanine, asparagine, glutamine, aspartate, glutamate, serine, and glycine. As a result of testing variables such as codon optimization, assembly polynucleotides encoding sequence motifs, expression of protein, charge distribution and solubility of expressed protein, and secondary and tertiary structure, it was discovered that XTEN compositions with enhanced characteristics mainly include glycine (G), alanine (A), serine (S), threonine (T), glutamate (E) and proline (P) residues wherein the sequences are designed to be substantially non-repetitive. In one embodiment, XTEN sequences have predominately four to six types of amino acids selected from glycine (G), alanine (A), serine (S), threonine (T), glutamate (E) or proline (P) that are arranged in a substantially non-repetitive sequence that is greater than about 36 to about 3000 amino acid residues in length. In some embodiments, XTEN have sequences of greater than about 36 to about 3000 amino acid residues wherein at least about 80% of the sequence consists of non-overlapping sequence motifs wherein each of the motifs has 9 to 36 amino acid residues wherein each of the motifs consists of 4 to 6 types of amino acids selected from glycine (G), alanine (A), serine (S), threonine (T), glutamate (E) and proline (P), and wherein the content of any one amino acid type in the full-length XTEN does not exceed 30%. In other embodiments, at least about 90% of the XTEN sequence consists of non-overlapping sequence motifs wherein each of the motifs has 9 to 36 amino acid residues wherein the motifs consist of 4 to 6 types of amino acids selected from glycine (G), alanine (A), serine (S), threonine (T), glutamate (E) and proline (P), and wherein the content of any one amino acid type in the full-length XTEN does not exceed 30%. In other embodiments, at least about 90% of the XTEN sequence consists of non-overlapping sequence motifs wherein each of the motifs has 12 amino acid residues consisting of 4 to 6 types of amino acids selected from glycine (G), alanine (A), serine (S), threonine (T), glutamate (E) and proline (P), and wherein the content of any one amino acid type in the full-length XTEN does not exceed 30%. In yet other embodiments, at least about 90%, or about 91%, or about 92%, or about 93%, or about 94%, or about 95%, or about 96%, or about 97%, or about 98%, or about 99%, to about 100% of the XTEN sequence consists of non-overlapping sequence motifs wherein each of the motifs has 12 amino acid residues consisting of glycine (G), alanine (A), serine (S), threonine (T), glutamate (E) and proline (P), and wherein the content of any one amino acid type in the full-length XTEN does not exceed 30%.

In still other embodiments, XTENs comprise non-repetitive sequences of greater than about 36 to about 3000 amino acid residues wherein at least about 80%, or at least about 90%, or about 91%, or about 92%, or about 93%, or about 94%, or about 95%, or about 96%, or about 97%, or about 98%, or about 99% of the sequence consists of non-overlapping sequence motifs of 9 to 14 amino acid residues wherein the motifs consist of 4 to 6 types of amino acids selected from glycine (G), alanine (A), serine (S), threonine (T), glutamate (E) and proline (P), and wherein the sequence of any two contiguous amino acid residues in any one motif is not repeated more than twice in the sequence motif. In other embodiments, at least about 90%, or about 91%, or about 92%, or about 93%, or about 94%, or about 95%, or about 96%, or about 97%, or about 98%, or about 99% of an XTEN sequence consists of non-overlapping sequence motifs of 12 amino acid residues wherein the motifs consist of four to six types of amino acids selected from glycine (G), alanine (A), serine (S), threonine (T), glutamate (E) and proline (P), and wherein the sequence of any two contiguous amino acid residues in any one sequence motif is not repeated more than twice in the sequence motif. In other embodiments, at least about 90%, or about 91%, or about 92%, or about 93%, or about 94%, or about 95%, or about 96%, or about 97%, or about 98%, or about 99% of an XTEN sequence consists of non-overlapping sequence motifs of 12 amino acid residues wherein the motifs consist of glycine (G), alanine (A), serine (S), threonine (T), glutamate (E) and proline (P), and wherein the sequence of any two contiguous amino acid residues in any one sequence motif is not repeated more than twice in the sequence motif. In yet other embodiments, XTENs consist of 12 amino acid sequence motifs wherein the amino acids are selected from glycine (G), alanine (A), serine (S), threonine (T), glutamate (E) and proline (P), and wherein the sequence of any two contiguous amino acid residues in any one sequence motif is not repeated more than twice in the sequence motif, and wherein the content of any one amino acid type in the full-length XTEN does not exceed 30%. In the foregoing embodiments hereinabove described in this paragraph, the XTEN sequences are "substantially non-repetitive."

In some embodiments, the invention provides compositions comprising one, or two, or three, or four or more non-repetitive XTEN sequence(s) of about 36 to about 1000 amino acid residues, or cumulatively about 100 to about 3000 amino acid residues wherein at least about 80%, or at least about 90%, or about 91%, or about 92%, or about 93%, or about 94%, or about 95%, or about 96%, or about 97%, or about 98%, or about 99% to about 100% of the sequence consists of multiple units of two or more non-overlapping sequence motifs selected from the amino acid sequences of Table 3, wherein the overall sequence remains substantially non-repetitive. In some embodiments, the XTEN comprises non-overlapping sequence motifs in which about 80%, or at least about 85%, or at least about 90%, or about 91%, or about 92%, or about 93%, or about 94%, or about 95%, or about 96%, or about 97%, or about 98%, or about 99% or about 100% of the sequence consists of multiple units of two or more non-overlapping sequences selected from a single motif family selected from Table 3, resulting in a family sequence. As used herein, "family" means that the XTEN has motifs selected only from a single motif category from Table 3; i.e., AD, AE, AF, AG, AM, AQ, BC, or BD XTEN, and that any other amino acids in the XTEN not from a family motif are selected to achieve a needed property, such as to permit incorporation of a restriction site by the encoding nucleotides, incorporation of a cleavage sequence, or to achieve a better linkage to an binding protein component.

TABLE 3

XTEN Sequence Motifs of 12 Amino Acids and Motif Families

| Motif Family* | MOTIF SEQUENCE | SEQ ID NO: |
|---|---|---|
| AD | GESPGGSSGSES | 2 |
| AD | GSEGSSGPGESS | 3 |
| AD | GSSESGSSEGGP | 4 |
| AD | GSGGEPSESGSS | 5 |

TABLE 3-continued

XTEN Sequence Motifs of 12 Amino Acids and Motif Families

| Motif Family* | MOTIF SEQUENCE | SEQ ID NO: |
|---|---|---|
| AE, AM | GSPAGSPTSTEE | 6 |
| AE, AM, AQ | GSEPATSGSETP | 7 |
| AE, AM, AQ | GTSESATPESGP | 8 |
| AE, AM, AQ | GTSTEPSEGSAP | 9 |
| AF, AM | GSTSESPSGTAP | 10 |
| AF, AM | GTSTPESGSASP | 11 |
| AF, AM | GTSPSGESSTAP | 12 |
| AF, AM | GSTSSTAESPGP | 13 |
| AG, AM | GTPGSGTASSSP | 14 |
| AG, AM | GSSTPSGATGSP | 15 |
| AG, AM | GSSPSASTGTGP | 16 |
| AG, AM | GASPGTSSTGSP | 17 |
| AQ | GEPAGSPTSTSE | 18 |
| AQ | GTGEPSSTPASE | 19 |
| AQ | GSGPSTESAPTE | 20 |
| AQ | GSETPSGPSETA | 21 |
| AQ | GPSETSTSEPGA | 22 |
| AQ | GSPSEPTEGTSA | 23 |
| BC | GSGASEPTSTEP | 24 |
| BC | GSEPATSGTEPS | 25 |
| BC | GTSEPSTSEPGA | 26 |
| BC | GTSTEPSEPGSA | 27 |
| BD | GSTAGSETSTEA | 28 |
| BD | GSETATSGSETA | 29 |
| BD | GTSESATSESGA | 30 |
| BD | GTSTEASEGSAS | 31 |

*Denotes individual motif sequences that, when used together in various permutations, results in a "family sequence"

In some embodiments of XTEN families, an XTEN sequence comprises multiple units of non-overlapping sequence motifs of the AD motif family, or an XTEN sequence comprises multiple units of non-overlapping sequence motifs of the AE motif family, or an XTEN sequence comprises multiple units of non-overlapping sequence motifs of the AF motif family, or an XTEN sequence comprises multiple units of non-overlapping sequence motifs of the AG motif family, or an XTEN sequence comprises multiple units of non-overlapping sequence motifs of the AM motif family, or an XTEN sequence comprises multiple units of non-overlapping sequence motifs of the AQ motif family, or an XTEN sequence comprises multiple units of non-overlapping sequence motifs of the BC family, or an XTEN sequence comprises multiple units of non-overlapping sequence motifs of the BD family, with the resulting XTEN exhibiting the range of homology described above. In other embodiments, the XTEN comprises multiple units of motif sequences from two or more of the motif families of Table 3, selected to achieve desired physicochemical characteristics, including such properties as net charge, lack of secondary structure, or lack of repetitiveness that may be conferred by the amino acid composition of the motifs, described more fully below. In the embodiments hereinabove described in this paragraph, the motifs incorporated into the XTEN can be selected and assembled using the methods described herein to achieve an XTEN of about 36 to about 3000 amino acid residues. Non-limiting examples of XTEN family sequences are presented in Table 4.

TABLE 4

XTEN Polypeptides

| XTEN Name | Amino Acid Sequence | SEQ ID NO: |
|---|---|---|
| AE42_1 | TEPSEGSAPGSPAGSPTSTEEGTSESATPESGPGSEPATSGS | 32 |
| AE42_2 | PAGSPTSTEEGTSTEPSEGSAPGTSESATPESGPGSEPATSG | 33 |
| AE42_3 | SEPATSGSETPGTSESATPESGPGTSTEPSEGSAPGSPAGSP | 34 |
| AG42_1 | GAPSPSASTGTGPGTPGSGTASSSPGSSTPSGATGSPGPSGP | 35 |
| AG42_2 | GPGTPGSGTASSSPGSSTPSGATGSPGSSPSASTGTGPGASP | 36 |
| AG42_3 | SPSASTGTGPGASPGTSSTGSPGTPGSGTASSSPGSSTPSGA | 37 |
| AG42_4 | SASTGTGPGASPGTSSTGSPGTPGSGTASSSPGSSTPSGATG | 38 |
| AE48 | MAEPAGSPTSTEEGTPGSGTASSSPGSSTPSGATGSPGASPGTSSTGS | 39 |
| AM48 | MAEPAGSPTSTEEGASPGTSSTGSPGSSTPSGATGSPGSSTPSGATGS | 40 |
| AE144 | GSEPATSGSETPGTSESATPESGPGSEPATSGSETPGSPAGSPTSTEEGTSTEPSEG SAPGSEPATSGSETPGSEPATSGSETPGSEPATSGSETPGTSTEPSEGSAPGTSESA TPESGPGSEPATSGSETPGTSTEPSEGSAP | 41 |
| AF144 | GTSTPESGSASPGTSPSGESSTAPGTSPSGESSTAPGTSSTAESPGPGSTSESPSG TAPGTSSTAESPGPGTSPSGESSTAPGTSTPESGSASPGTSSTAESPGPGTSPSG ESSTAPGTSPSGESSTAP | 42 |
| AG144_1 | PGSSPSASTGTGPGSSPSASTGTGPGTPGSGTASSSPGSSTPSGATGSPGSSPSAST GTGPGASPGTSSTGSPGTPGSGTASSSPGSSTPSGATGSPGTPGSGTASSSPGASP GTSSTGSPGASPGTSSTGSPGTPGSGTASSS | 43 |
| AG144_2 | SGTASSSPGSSTPSGATGSPGTPGSGTASSSPGSSTPSGATGSPGSSTPSGATGSP GSSPSASTGTGPGSSPSASTGTGPGASPGTSSTGSPGTPGSGTASSSPGSSTPSGA TGSPGSSPSASTGTGPGSSPSASTGTGPGASP | 44 |
| AG144_3 | GTPGSGTASSSPGSSTPSGATGSPGSSTPSGATGSPGSSPSASTGTGPGSSPSAST GTGPGASPGTSSTGSPGTPGSGTASSSPGSSTPSGATGSPGSSPSASTGTGPGSSP SASTGTGPGASPGTSSTGSPGASPGTSSTGSP | 45 |
| AG144_4 | GTPGSGTASSSPGSSTPSGATGSPGSSPSASTGTGPGSSPSASTGTGPGASPGTSS TGSPGASPGTSSTGSPGSSTPSGATGSPGSSPSASTGTGPGASPGTSSTGSPGSSPS ASTGTGPGTPGSGTASSSPGSSTPSGATGSP | 46 |
| AE288 | GTSESATPESGPGSEPATSGSETPGTSESATPESGPGSEPATSGSETPGTSESATPE SGPGTSTEPSEGSAPGSPAGSPTSTEEGTSESATPESGPGSEPATSGSETPGTSESA TPESGPGSPAGSPTSTEEGTSTEPSEGSAPGTSESATPESGPGTS ESATPESGPGTSESATPESGPGSEPATSGSETPGSEPATSGSETPGSPAGSPTSTEE GTSTEPSEGSAPGTSTEPSEGSAPGSEPATSGSETPGTSESATPESGPGTSTEPSEG SAP | 47 |
| AG288_1 | ASSSPGASPGTSSTGSPGASPGTSSTGSPGASPGTSSTGSPGASPGTSSTGSPGTP GSGTASSSPGSSTPSGATGSPGTPGSGTASSSPGSSTPSGATGSPGTPGSGTASSS PGSSTPSGATGSPGSSTPSGATGSPGSSPSASTGTGPGSSPSASTGTGPGASPGTS STGPGTPGSGTASSSPGSSTPSGATGSPGSSPSASTGTGPGSSPSASTGTGPGAS PGTSSTGSPGASPGTSSTGSPGSSTPSGATGSPGSSPSASTGTGPGASPGTSSTGSP GSSPSASTGTGPGTPGSGTASSSPGSSTPSGATGS | 48 |
| AG288_2 | PGASPGTSSTGSPGASPGTSSTGSPGTPGSGTASSSPGSSTPSGATGSPGTPGSGT ASSSPGSSTPSGATGSPGTPGSGTASSSPGSSTPSGATGSPGSSTPSGATGSPGSSP SASTGTGPGSSPSASTGTGPGASPGTSSTGSPGTPGSGTASSSPGSSTPSGATGSP GSSPSASTGTGPGSSPSASTGTGPGASPGTSSTGSPGASPGTSSTGSPGSSTPSGA TGSPGSSPSASTGTGPGASPGTSSTGSPGSSPSASTGTGPGTPGSGTASSSPGSSTP SGATGS | 49 |
| AG288_3 | GSSPSASTGTGPGSSPSASTGTGPGTPGSGTASSSPGSSTPSGATGSPGSSPSAST GTGPGASPGTSSTGSPGTPGSGTASSSPGSSTPSGATGSPGTPGSGTASSSPGASP GTSSTGSPGASPGTSSTGSPGTPGSGTASSSPGSSTPSGATGSPGSSPSASTGTGSP GTPGSGTASSSPGSSTPSGATGSPGSSPSASTGTGPGSSPSASTGTGPGSSTPSGA | 50 |

TABLE 4-continued

XTEN Polypeptides

| XTEN Name | Amino Acid Sequence | SEQ ID NO: |
|---|---|---|
| | TGSPGSSTPSGATGSPGASPGTSSTGSPGASPGTSSTGSPGTPG GSTASSSP | |
| AF504 | GASPGTSSTGSPGSSPSASTGTGPGSSPSASTGTGPGTPGSGTASSSPGSSTPSGA TGSPGSXPSASTGTGPGASPGTSSTGSPGTPGSGTASSSPGSSTPSGATGSPGTPG SGTASSSPGASPGTSSTGSPGASPGTSSTGSPGTPGSGTASSSPGSSTPSGATGSP GASPGTSSTGSPGTPGSGTASSSPGSSTPSGATGSPGSXPSASTGTGPGSSPSAST GTGPGSSTPSGATGSPGSSTPSGATGSPGASPGTSSTGSPGASP GTSSTGSPGTPGSGTASSSPGASPGTSSTGSPGASPGTSSTGSPGASPGTSSTGSP GSSPSASTGTGPGTPGSGTASSSPGASPGTSSTGSPGASPGTSSTGSPGASPGTSS TGSPGSSTPSGATGSPGSSTPSGATGSPGASPGTSSTGSPGTPGSGTASSSPGSSTP SGATGSPGSSTPSGATGSPGSSTPSGATGSPGSSPSASTGTGPGASPGTSSTGSP | 51 |
| AF540 | GSTSSTAESPGPGSTSSTAESPGPGSTSESPSGTAPGSTSSTAESPGPGSTSSTAES PGPGTSTPESGSASPGSTSESPSGTAPGTSPSGESSTAPGSTSESPSGTAPGSTSES PSGTAPGTSPSGESSTAPGSTSESPSGTAPGSTSESPSGTAPGTSPSGESSTAPGST SESPSGTAPGSTSESPSGTAPGTSTPESGSASPGSTSESPSGTAP GTSTPESGSASPGSTSSTAESPGPGSTSSTAESPGPGTSTPESGSASPGTSTPESGS ASPGSTSESPSGTAPGTSTPESGSASPGTSTPESGSASPGSTSESPSGTAPGSTSES PSGTAPGSTSESPSGTAPGSTSSTAESPGPGTSTPESGSASPGTSTPESGSASPGST SESPSGTAPGSTSESPSGTAPGTSTPESGSASPGSTSESPSGTAPGSTSESPSGTAP GTSTPESGSASPGTSPSGESSTAPGSTSSTAESPGPGTSPSGESSTAPGSTSSTAES PGPGTSTPESGSASPGSTSESPSGTAP | 52 |
| AD576 | GSSESGSSEGGPGSGGEPSESGSSGSSESGSSEGGPGSSESGSSEGGPGSSESGSSE GGPGSSESGSSEGGPGSSESGSSEGGPGESPGGSSGSESGSEGSSGPGESSGSSES GSSEGGPGSSESGSSEGGPGSSESGSSEGGPGSGGEPSESGSSGESPGGSSGSESG ESPGGSSGSESGSGGEPSESGSSGSSESGSSEGGPGSGGEPSESGSSGSGGEPSES GSSGSEGSSGPGESSGESPGGSSGSESGSGGEPSESGSSGSGGEPSESGSSGSGGE PSESGSSGSESGSSEGGPGESPGGSSGSESGESPGGSSGSESGESPGGSSGSESGE SPGGSSGSESGESPGGSSGSESGSSESGSSEGGPGSGGEPSESGSSGSEGSSGPGE SSGSSESGSSEGGPGSGGEPSESGSSGSSESGSSEGGPGSGGEPSESGSSGESPGG SSGSESGESPGGSSGSESGSSESGSSEGGPGSGGEPSESGSSGSSESGSSEGGPGS GGEPSESGSSGSGGEPSESGSSGESPGGSSGSESGSEGSSGPGESSGSSESGSSEG GPGSEGSSGPGESS | 53 |
| AE576 | GSPAGSPTSTEEGTSESATPESGPGTSTEPSEGSAPGSPAGSPTSTEEGTSTEPSEG SAPGTSTEPSEGSAPGTSESATPESGPGSEPATSGSETPGSEPATSGSETPGSPAGS PTSTEEGTSESATPESGPGTSTEPSEGSAPGTSTEPSEGSAPGSPAGSPTSTEEGTS TEPSEGSAPGTSTEPSEGSAPGTSESATPESGPGTSTEPSEGSAPGTSESATPESGP GSEPATSGSETPGTSTEPSEGSAPGTSTEPSEGSAPGTSESATPESGPGTSESATPE SGPGSPAGSPTSTEEGTSESATPESGPGSEPATSGSETPGTSESATPESGPGTSTEP SEGSAPGTSTEPSEGSAPGTSTEPSEGSAPGTSTEPSEGSAPGTSTEPSEGSAPGTS TEPSEGSAPGSPAGSPTSTEEGTSTEPSEGSAPGTSESATPESGPGSEPATSGSETP GTSESATPESGPGSEPATSGSETPGTSESATPESGPGTSTEPSEGSAPGTSESATPE SGPGSPAGSPTSTEEGSPAGSPTSTEEGTSESATPESGPGTSTEP SEGSAP | 54 |
| AF576 | GSTSSTAESPGPGSTSSTAESPGPGSTSESPSGTAPGSTSSTAESPGPGSTSSTAES PGPGTSTPESGSASPGSTSESPSGTAPGTSPSGESSTAPGSTSESPSGTAPGSTSES PSGTAPGTSPSGESSTAPGSTSESPSGTAPGSTSESPSGTAPGTSPSGESSTAPGST SESPSGTAPGSTSESPSGTAPGSTSESPSGTAPGTSTPESGSASPGSTSESPSGTAP GTSTPESGSASPGSTSSTAESPGPGTSSTAESPGPGTSTPESGSASPGTSTPESGSA SPGSTSESPSGTAPGTSTPESGSASPGTSTPESGSASPGSTSESPSGTAPGSTSES PSGTAPGSTSESPSGTAPGSTSSTAESPGPGTSTPESGSASPGTSTPESGSASPGST SESPSGTAPGSTSESPSGTAPGTSTPESGSASPGTSESPSGTAPGSTSESPSGTAP GTSTPESGSASPGTSPSGESSTAPGSTSSTAESPGPGTSPSGESSTAPGSTSSTAES PGPGTSTPESGSASPGSTSESPSGTAPGSTSSTAESPGPGTSTPESGSASPGTSTPE SGSASP | 55 |
| AG576 | PGTPGSGTASSSPGSSTPSGATGSPGSSPSASTGTGPGSSPSASTGTGPGSSTPSG ATGSPGSSTPSGATGSPGASPGTSSTGSPGASPGTSSTGSPGASPGTSSTGSPGTP GSGTASSSPGASPGTSSTGSPGASPGTSSTGSPGASPGTSSTGSPGSSPSASTGTG PGTPGSGTASSSPGASPGTSSTGSPGASPGTSSTGSPGASPGTSSTGSPGSSTPSG ATGSPGSSTPSGATGSPGASPGTSSTGSPGTPGSGTASSSPGSSTPSGATGSPGSS TPSGATGSPGSSTPSGATGSPGSSPSASTGTGPGASPGTSSTGS PGTPGSGTASSSPGASPGTSSTGSPGASPGTSSTGSPGASPGTSSTGSPGASPGTS STGSPGTPGSGTASSSPGSSTPSGATGSPGTPGSGTASSSPGSSTPSGATGSPGTP GSGTASSSPGSSTPSGATGSPGSSTPSGATGSPGSSPSASTGTGPGSSPSASTGTG PGASPGTSSTGSPGTPGSGTASSSPGSSTPSGATGSPGSSPSASTGTGPGSSPSAST GTGPGASPGTSSTGS | 56 |
| AE624 | MAEPAGSPTSTEEGTPGSGTASSSPGSSTPSGATGSPGASPGTSSTGSPGSPAGSP TSTEEGTSESATPESGPGTSTEPSEGSAPGSPAGSPTSTEEGTSTEPSEGSAPGTST EPSEGSAPGTSESATPESGPGSEPATSGSETPGSEPATSGSETPGSPAGSPTSTEEG | 57 |

TABLE 4-continued

XTEN Polypeptides

| XTEN Name | Amino Acid Sequence | SEQ ID NO: |
|---|---|---|
| | TSESATPESGPGTSTEPSEGSAPGTSTEPSEGSAPGSPAGSPTSTEEGTSTEPSEGS APGTSTEPSEGSAPGTSESATPESGPGTSTEPSEGSAPGTSESATPESGPGSEPATS GSETPGTSTEPSEGSAPGTSTEPSEGSAPGTSESATPESGPGTSESATPESGPGSPA GSPTSTEEGTSESATPESGPGSEPATSGSETPGTSESATPESGPGTSTEPSEGSAPG TSTEPSEGSAPGTSTEPSEGSAPGTSTEPSEGSAPGTSTEPSEGSAPGTSTEPSEGS APGSPAGSPTSTEEGTSTEPSEGSAPGTSESATPESGPGSEPATSGSETPGTSESAT PESGPGSEPATSGSETPGTSESATPESGPGTSTEPSEGSAPGTSESATPESGPSPA GSPTSTEEGSPAGSPTSTEEGSPAGSPTSTEEGTSESATPESGPGTSTEPSEGSAP | |
| AD836 | GSSESGSSEGGPGSSESGSSEGGPGESPGGSSGSESGSGGGEPSESGSSGESPGGSS GSESGESPGGSSGSESGSSESGSSEGGPGSSESGSSEGGPGSSESGSSEGGPGESP GGSSGSESGESPGGSSGSESGESPGGSSGSESGSSESGSSEGGPGSSESGSSEGGP GSSESGSSEGGPGSSESGSSEGGPGSSESGSSEGGPGSSESGSSEGGPGSGGEPSE SGSSGESPGGSSGSESGESPGGSSGSESGSGGEPSESGSSGSESGSGPGESSGSSES GSSEGGPGSGGEPSESGSSGSEGSSGPGESSGSSESGSSEGGPGSGGEPSESGSSG ESPGGSSGSESGSGGEPSESGSSGSGGEPSESGSSGSSESGSSEGGPGSGGEPSES GSSGSGGEPSESGSSGSEGSSGPGESSGESPGGSSGSESGSESSGPGESSGSEGS SGPGESSGSGGEPSESGSSGSSESGSSEGGPGSSESGSSEGGPGESPGGSSGSESG SGGEPSESGSSGSEGSSGPGESSGESPGGSSGSESGSEGSSGPGSSESGSSEGGPG SGGEPSESGSSGSEGSSGPGSSGSESGSSGPGESSGSSESGSSGGEPSES GSSGSGGEPSESGSSGESPGGSSGSESGESPGGSSGSESGSGGEPSESGSSGSEGS SGPGESSGESPGGSSGSESGSSESGSSEGGPGSSESGSSEGGPGSSESGSSEGGPG SGGEPSESGSSGSSESGSSEGGPGESPGGSSGSESGSGGEPSESGSSGSSESGSSEG GPGESPGGSSGSESGSGGEPSESGSSGESPGGSGSESGSGGEPSESGSS | 58 |
| AE864 | GSPAGSPTSTEEGTSESATPESGPGTSTEPSEGSAPGSPAGSPTSTEEGTSTEPSEG SAPGTSTEPSEGSAPGTSESATPESGPGSEPATSGSETPGSEPATSGSETPGSPAGS PTSTEEGTSESATPESGPGTSTEPSEGSAPGTSTEPSEGSAPGSPAGSPTSTEEGTS TEPSEGSAPGTSTEPSEGSAPGTSESATPESGPGTSTEPSEGSAPGTSESATPESGP GSEPATSGSETPGTSTEPSEGSAPGTSTEPSEGSAPGTSESATPESGPGTSESATPE SGPGSPAGSPTSTEEGTSESATPESGPGSEPATSGSETPGTSESATPESGPGTSTEP SEGSAPGTSTEPSEGSAPGTSTEPSEGSAPGTSTEPSEGSAPGTSTEPSEGSAPGTS TEPSEGSAPGSPAGSPTSTEEGTSTEPSEGSAPGTSESATPESGPGSEPATSGSETP GTSESATPESGPGSEPATSGSETPGTSESATPESGPGTSTEPSEGSAPGTSESATPE SGPGSPAGSPTSTEEGSPAGSPTSTEEGSPAGSPTSTEEGTSESATPESGPGTSTEP SEGSAPGTSESATPESGPGSEPATSGSETPGTSESATPESGPGSEPATSGSETPGTS ESATPESGPGTSTEPSEGSAPGSPAGSPTSTEEGTSESATPESGPGSEPATSGSETP GTSESATPESGPGSPAGSPTSTEEGSPAGSPTSTEEGTSTEPSEGSAPGTSESATPE SGPGTSESATPESGPGTSESATPESGPGSEPATSGSETPGSEPATSGSETPGSPAGS PTSTEEGTSTEPSEGSAPGTSTEPSEGSAPGSEPATSGSETPGTSESATPESGPGTS TEPSEGSAP | 59 |
| AF864 | GSTSESPSGTAPGTSPSGESSTAPGSTSESPSGTAPGSTSESPSGTAPGTSTPESGS ASPGTSTPESGSASPGSTSESPSGTAPGSTSESPSGTAPGTSPSGESSTAPGTSESES PSGTAPGTSPSGESSTAPGTSPSGESSTAPGSTSSTAESPGPGTSPSGESSTAPGTS PSGESSTAPGSTSSTAESPGPGTSTPESGSASPGSTSESPSGTAP GSTSESPSGTAPGTSTPESGSASPGSTSSTAESPGPGTSTPESGSASPGSTSESPSG TAPGTSPSGESSTAPGSTSSTAESPGPGTSPSGESSTAPGTSTPESGSASPGSTSST AESPGPGSTSSTAESPGPGSTSSTAESPGPGTSSTAESPGPGSTSSTAESPGPGTSPSGESSTAPGST SESPSGTAPGSTSESPSGTAPGTSTPESGPXXXGASASGAPSTXXXXSESPSGTAP GSTSESPSGTAPGSTSESPSGTAPGSTSESPSGTAPGSTSESPSGTAPGSTSESPSG TAPGTSTPESGSASPGTSPSGESSTAPGTSPSGESSTAPGSTSSTAESPGPGTSPSG ESSTAPGTSTPESGSASPGSTSESPSGTAPGSTSESPSGTAPGTSPSGESSTAPGST SESPSGTAPGSTSTPESGSASPGTSTPESGSASPGSTSESPSGTAPGSTSTPESGSASP GSTSSTAESPGPGSTSESPSGTAPGSTSESPSGTAPGSTPSGESSTAPGSTSSTAES PGPGTSPSGESSTAPGSTSTPESGSASPGTSPSGESSTAPGSTSPSGESSTAPGSTSPSG ESSTAPGSTSSTAESPGPGSTSSTAESPGPGSTSPSGESSTAPGSSPASTGTGPGSS TPSGATGSPGSSTPSGATGSP | 60 |
| AG864 | GASPGTSSTGSPGSSPSASTGTGPGSSPSASTGTGPGTPGSGTASSSPGSSTPSGA TGSPGSSPSASTGTGPGASPGTSSTGSPGTPGSGTASSSPGSSTPSGATGSPGTPG SGTASSSPGASPGTSSTGSPGASPGTSSTGSPGTPGSGTASSSPGSSTPSGATGSP GASPGTSSTGSPGTPGSGTASSSPGSSTPSGATGSPGSSPSASTGTGPGSSPSAST GTGPGSSTPSGATGSPGSSTPSGATGSPGASPGTSSTGSPGASPGTSSTGSPGASP GTSSTGSPGTPGSGTASSSPGASPGTSSTGSPGASPGTSSTGSPGASPGTSSTGSP GSSPSASTGTGPGTPGSGTASSSPGASPGTSSTGSPGASPGTSSTGSPGASPGTSS TGSPGSSTPSGATGSPGSSTPSGATGSPGASPGTSSTGSPGTPGSGTASSSPGSSTP SGATGSPGSSTPSGATGSPGSSPSASTGTGPGASPGTSSTGSPG ASPGTSSTGSPGTPGSGTASSSPGASPGTSSTGSPGASPGTSSTGSPGASPGTSST GSPGASPGTSSTGSPGTPGSGTASSSPGSSTGATGSPGTPGSGTASSSPGSSTPS GATGSPGTPGSGTASSSPGSSTPSGATGSPGSSTPSGATGSPGSSPSASTGTGPGS SPSASTGTGPGASPGTSSTGSPGTPGSGTASSSPGSSTPSGATGSPGSSPSASTGT GPGSSPSASTGTGPGASPGTSSTGSPGASPGTSSTGSPGSSTPSGATGSPGSSPSAS TGTGPGASPGTSSTGSPGSSPSASTGTGPGTPGSGTASSSPGSSTPSGATGSPGSS TPSGATGSPGASPGTSSTGSP | 61 |

TABLE 4-continued

XTEN Polypeptides

| XTEN Name | Amino Acid Sequence | SEQ ID NO: |
|---|---|---|
| AM875 | GTSTEPSEGSAPGSEPATSGSETPGSPAGSPTSTEEGSTSSTAESPGPGTSTPESGS ASPGSTSESPSGTAPGSTSESPSGTAPGTSTPESGSASPGTSTPESGSASPGSEPAT SGSETPGTSESATPESGPGSPAGSPTSTEEGTSTEPSEGSAPGTSESATPESGPGTS TEPSEGSAPGTSTEPSEGSAPGSPAGSPTSTEEGTSTEPSEGSAPGTSTEPSEGSAP GTSESATPESGPGTSESATPESGPGTSTEPSEGSAPGTSTEPSEGSAPGTSESATPE SGPGTSTEPSEGSAPGSEPATSGSETPGSPAGSPTSTEEGSSTPSGATGSPGTPGS GTASSSPGSSTPSGATGSPGTSTEPSEGSAPGTSTEPSEGSAPGSEPATSGSETPGS PAGSPTSTEEGSPAGSPTSTEEGTSTEPSEGSAPGASASGAPSTGGTSESATPESG PGSPAGSPTSTEEGSPAGSPTSTEEGTSSSTAESPGPGTSSESPSGTAPGTSPSGES STAPGTPGSGTASSSPGSSTPSGATGSPGSSPSASTGTGPGSEPATSGSETPGTSES ATPESGPGSEPATSGSETPGTSSTAESPGPGTSSSTAESPGPGTSPSGESSTAPGS EPATSGSETPGSEPATSGSETPGTSTEPSEGSAPGSTSSTAESPGPGTSTPESGSAS PGSTSESPSGTAPGTSTEPSEGSAPGTSTEPSEGSAPGTSTEPSEGSAPGSSTPSGA TGSPGSSPSASTGTGPGASPGTSSTGSPGSEPATSGSETPGTSESATPESGPGSPA GSPTSTEEGSSTPSGATGSPGSSPSASTGTGPGASPGTSSTGSPGTSESATPESGPG TSTEPSEGSAPGTSTEPSEGSAP | 62 |
| AE912 | MAEPAGSPTSTEEGTPGSGTASSSPGSSTPSGATGSPGASPGTSSTGSPGSPAGSP TSTEEGTSESATPESGPGTSTEPSEGSAPGSPAGSPTSTEEGTSTEPSEGSAPGTST EPSEGSAPGTSESATPESGPGSEPATSGSETPGSEPATSGSETPGSPAGSPTSTEEG TSESATPESGPGTSTEPSEGSAPGTSTEPSEGSAPGSPAGSPTSTEEGTSTEPSEGS APGTSTEPSEGSAPGTSESATPESGPGTSTEPSEGSAPGTSESATPESGPGSEPATS GSETPGTSTEPSEGSAPGTSTEPSEGSAPGTSESATPESGPGTSESATPESGPGSPA GSPTSTEEGTSESATPESGPGSEPATSGSETPGTSESATPESGPGTSTEPSEGSAPG TSTEPSEGSAPGTSTEPSEGSAPGSTSEPSEGSAPGTSTEPSEGSAPGTSTEPSEGS APGSPAGSPTSTEEGTSTEPSEGSAPGTSESATPESGPGSEPATSGSETPGTSESAT PESGPGSEPATSGSETPGTSESATPESGPGTSTEPSEGSAPGTSESATPESGPGSPA GSPTSTEEGSPAGSPTSTEEGSPAGSPTSTEEGTSESATPESGPGTSTEPSEGSAPG TSESATPESGPGSEPATSGSETPGTSESATPESGPGSEPATSGSETPGTSESATPES GPGTSTEPSEGSAPGSPAGSPTSTEEGTSESATPESGPGSEPATSGSETPGTSESAT PESGPGSPAGSPTSTEEGSPAGSPTSTEEGTSTEPSEGSAPGTSESATPESGPGTSE SATPESGPGTSESATPESGPGSEPATSGSETPGSEPATSGSETPGSPAGSPTSTEEG TSTEPSEGSAPGTSTEPSEGSAPGSEPATSGSETPGTSESATPESGPGTSTEPSEGS AP | 63 |
| AM923 | MAEPAGSPTSTEEGASPGTSSTGSPGSSTPSGATGSPGSSTPSGATGSPGTSTEPS EGSAPGSEPATSGSETPGSPAGSPTSTEEGSTSSTAESPGPGTSTPESGSASPGSTS ESPSGTAPGSTSESPSGTAPGTSTPESGSASPGTSTPESGGASPGSEPATSGSETPG TSESATPESGPGSPAGSPTSTEEGTSTEPSEGSAPGTSESATPESGPGTSTEPSEGS APGTSTEPSEGSAPGSPAGSPTSTEEGTSTEPSEGSAPGTSTEPSEGSAPGTSESAT PESGPGTSESATPESGPGTSTEPSEGSAPGTSTEPSEGSAPGTSESATPESGPGTST EPSEGSAPGSEPATSGSETPGSPAGSPTSTEEGSSTPSGATGSPGTPGSGTASSSPG SSTPSGATGSPGTSTEPSEGSAPGTSTEPSEGSAPGSEPATSGSETPGSPAGSPTST EEGSPAGSPTSTEEGTSTEPSEGSAPGASASGAPSTGGTSESATPESGPGSPAGSP TSTEEGSPAGSPTSTEEGTSSSTAESPGPGTSSESPSGTAPGTSPSGESSTAPGTPG SGTASSSPGSSTPSGATGSPGSSPSASTGTGPGSEPATSGSETPGTSESATPESGPG SEPATSGSETPGTSSTAESPGPGTSSSTAESPGPGTSPSGESSTAPGSEPATSGSE TPGSEPATSGSETPGTSTEPSEGSAPGTSSTAESPGPGTSTPESGSASPGSTSESP SGTAPGTSTEPSEGSAPGTSTEPSEGSAPGTSTEPSEGSAPGSSTPSGATGSPGSSP SASTGTGPGASPGTSSTGSPGSEPATSGSETPGTSESATPESGPGSPAGSPTSTEE GSSTPSGATGSPGSSPSASTGTGPGASPGTSSTGSPGTSESATPESGPGTSTEPSEG SAPGTSTEPSEGSAP | 64 |
| AM1318 | GTSTEPSEGSAPGSEPATSGSETPGSPAGSPTSTEEGSTSSTAESPGPGTSTPESGS ASPGSTSESPSGTAPGSTSESPSGTAPGTSTPESGSASPGTSTPESGSASPGSEPAT SGSETPGTSESATPESGPGSPAGSPTSTEEGTSTEPSEGSAPGTSESATPESGPGTS TEPSEGSAPGTSTEPSEGSAPGSPAGSPTSTEEGTSTEPSEGSAPGTSTEPSEGSAP GTSESATPESGPGTSESATPESGPGTSTEPSEGSAPGTSTEPSEGSAPGTSESATPE SGPGTSTEPSEGSAPGSEPATSGSETPGSPAGSPTSTEEGSSTPSGATGSPGTPGS GTASSSPGSSTPSGATGSPGTSTEPSEGSAPGTSTEPSEGSAPGSEPATSGSETPGS PAGSPTSTEEGSPAGSPTSTEEGTSTEPSEGSAPGPEPTGPAPSGGSEPATSGSETP GTSESATPESGPGSPAGSPTSTEEGTSESATPESGPGSPAGSPTSTEEGSPAGSPTS TEEGTSESATPESGPGSPAGSPTSTEEGSPAGSPTSTEEGTSSTAESPGPGSTSES PSGTAPGTSPSGESSTAPGSTSESPSGTAPGSTSESPSGTAPGTSPSGESSTAPGTS TEPSEGSAPGTSESATPESGPGTSESATPESGPGSEPATSGSETPGTSESATPESGP GTSESATPESGPGTSTEPSEGSAPGTSESATPESGPGTSTEPSEGSAPGTSPSGESS TAPGTSPSGESSTAPGTSPSGESSTAPGTSTEPSEGSAPGSPAGSPTSTEEGTSTEP SEGSAPGSSPSASTGTGPGSSTPSGATGSPGSSTPSGATGSPGSSTPSGATGSPGS STPSGATGSPGASPGTSSTGSPGASASGAPSTGGTSPSGESSTAPGTSSTAESPG PGTSPSGESSTAPGTSESATPESGPGTSTEPSEGSAPGTSTEPSEGSAPGSSPSAST GTGPGSSTPSGATGSPGASPGTSSTGSPGTSTPESGSASPGTSPSGESSTAPGTSPS GESSTAPGTSESATPESGPGSEPATSGSETPGTSTEPSEGSAPGSTSESPSGTAPGS TSESPSGTAPGTSTPESGSASPGSPAGSPTSTEEGTSESATPESGPGTSTEPSEGSA PGSPAGSPTSTEEGTSESATPESGPGSEPATSGSETPGSSTPSGATGSPGASPGTSS | 65 |

TABLE 4-continued

XTEN Polypeptides

| XTEN Name | Amino Acid Sequence | SEQ ID NO: |
|---|---|---|
| | TGSPGSSTPSGATGSPGSTSESPSGTAPGTSPSGESSTAPGSTSSTAESPGPGSSTP SGATGSPGASPGTSSTGSPGTPGSGTASSSPGSPAGSPTSEEGSPAGSPTSTEEG TSTEPSEGSAP | |
| BC 864 | GTSTEPSEPGSAGTSTEPSEPGSAGSEPATSGTEPSGSGASEPTSTEPGSEPATSGT EPSGSEPATSGTEPSGSEPATSGTEPSGSGASEPTSTEPGTSTEPSEPGSAGSEPAT SGTEPSGTSTEPSEPGSAGSEPATSGTEPSGSEPATSGTEPSGTSTEPSEPGSAGTS TEPSEPGSAGSEPATSGTEPSGSEPATSGTEPSGTSEPSTSEPGAGSGASEPTSTEP GTSEPSTSEPGAGSEPATSGTEPSGSEPATSGTEPSGTSTEPSEPGSAGTSTEPSEP GSAGSGASEPTSTEPGSEPATSGTEPSGSEPATSGTEPSGSEPATSGTEPSGSEPA TSGTEPSGTSTEPSEPGSAGSEPATSGTEPSGSGASEPTSTEPGTSTEPSEPGSAGS EPATSGTEPSGSGASEPTSTEPGTSTEPSEPGSAGSGASEPTSTEPGSEPATSGTEP SGSGASEPTSTEPGSEPATSGTEPSGSGASEPTSTEPGTSTEPSEPGSAGSEPATSG TEPSGSGASEPTSTEPGTSTEPSEPGSAGSEPATSGTEPSGTSTEPSEPGSAGSEPA TSGTEPSGTSTEPSEPGSAGTSTEPSEPGSAGTSTEPSEPGSAGTSTEPSEPGSAGT STEPSEPGSAGTSTEPSEPGSAGTSEPSTSEPGAGSGASEPTSTEPGTSTEPSEPGS AGTSTEPSEPGSAGTSTEPSEPGSAGSEPATSGTEPSGSGASEPTSTEPGSEPATS GTEPSGSEPATSGTEPSGSEPATSGTEPSGSEPATSGTEPSGTSEPSTSEPGAGSEP ATSGTEPSGSGASEPTSTEPGTSTEPSEPGSAGSEPATSGTEPSGSGASEPTSTEPG TSTEPSEPGSA | 66 |
| BD864 | GSETATSGSETAGTSESATSESGAGSTAGSETSTEAGTSESATSESGAGSETATS GSETAGSETATSGSETAGTSTEASEGSASGTSTEASEGSASGTSESATSESGAGS ETATSGSETAGTSTEASEGSASGTAGSETSTEAGTSESATSESGAGTSESATSES GAGSETATSGSETAGTSESATSESGAGTSTEASEGSASGSETATSGSETAGSETA TSGSETAGTSTEASEGSASGSTAGSETSTEAGTSESATSESGAGTSTEASEGSAS GSETATSGSETAGSTAGSETSTEAGSTAGSETSTEAGSETATSGSETAGTSESAT SESGAGTSESATSESGAGSETATSGSETAGTSESATSESGAGTSESATSESGAGS ETATSGSETAGSETATSGSETAGTSTEASEGSASGSTAGSETSTEAGSETATSGS ETAGTSESATSESGAGSTAGSETSTEAGSTAGSETSTEAGSTAGSETSTEAGTST EASEGSASGSTAGSETSTEAGSTAGSETSTEAGTSTEASEGSASGSTAGSETSTE AGSETATSGSETAGTSTEASEGSASGTSESATSESGAGSETATSGSETAGTSESA TSESGAGTSESATSESGAGSETATSGSETAGTSESATSESGAGSETATSGSETAG TSTEASEGSASGTSTEASEGSASGSTAGSETSTEAGSTAGSETSTEAGSETATSGS ETAGTSESATSESGAGTSESATSESGAGSETATSGSETAGSETATSGSETAGSET ATSGSETAGTSTEASEGSASGTSESATSESGAGSETATSGSETAGSETATSGSET AGTSESATSESGAGTSESATSESGAGSETATSGSETA | 67 |
| AE948 | GTSTEPSEGSAPGTSESATPESGPGSEPATSGSETPGTSESATPESGPGTSTEPSEG SAPGSPAGSPTSTEEGTSTEPSEGSAPGSEPATSGSETPGTSESATPESGPGTSESA TPESGPGSEPATSGSETPGTSTEPSEGSAPGTSESATPESGPGTSTEPSEGSAPGTS TEPSEGSAPGSEPATSGSETPGTSTEPSEGSAPGSEPATSGSETPGSEPATSGSETP GTSTEPSEGSAPGSEPATSGSETPGSEPATSGSETPGTSTEPSEGSAPGSEPATSGS ETPGSPAGSPTSTEEGTSESATPESGPGTSTEPSEGSAPGSEPATSGSETPGTSESA TPESGPGSEPATSGSETPGSEPATSGSETPGTSESATPESGPGSPAGSPTSTEEGTS ESATPESGPGSPAGSPTSTEEGTSTEPSEGSAPGTSESATPESGPGTSTEPSEGSAP GTSTEPSEGSAPGSPAGSPTSTEEGTSTEPSEGSAPGTSESATPESGPGSPAGSPTS TEEGSPAGSPTSTEEGTSESATPESGPGTSESATPESGPGTSTEPSEGSAPGSPAGS PTSTEEGTSESATPESGPGTSTEPSEGSAPGSEPATSGSETPGSPAGSPTSTEEGTS ESATPESGPGTSTEPSEGSAPGSEPATSGSETPGSEPATSGSETPGSEPATSGSETP GSPAGSPTSTEEGTSESATPESGPGSEPATSGSETPGSEPATSGSETPGSPAGSPTS TEEGSPAGSPTSTEEGSPAGSPTSTEEGTSESATPESGPGSEPATSGSETPGTSTEP SEGSAPGTSTEPSEGSAPGSPAGSPTSTEEGSPAGSPTSTEEGPAGSPTSTEEGTS TEPSEGSAPGTSESATPESGPGTSESATPESGPGTSTEPSEGSAPGTSTEPSEGSAP GTSTEPSEGSAPGTSESATPESGPGTSESATPESGP | 68 |
| AE1044 | GSEPATSGSETPGSEPATSGSETPGTSTEPSEGSAPGTSESATPESGPGSPAGSPTS TEEGTSTEPSEGSAPGTSESATPESGPGTSESATPESGPGSEPATSGSETPGSEPAT SGSETPGTSESATPESGPGTSESATPESGPGSPAGSPTSTEEGTSTEPSEGSAPGSE PATSGSETPGTSTEPSEGSAPGSPAGSPTSTEEGSPAGSPTSTEEGSPAGSPTSTEE GTSTEPSEGSAPGTSESATPESGPGSEPATSGSETPGTSESATPESGPGTSESATPE SGPGSPAGSPTSTEEGTSTEPSEGSAPGSEPATSGSETPGTSESATPESGPGTSESA TPESGPGSPAGSPTSTEEGTSTEPSEGSAPGTSTEPSEGSAPGSPAGSPTSTEEGTS TEPSEGSAPGTSESATPESGPGSPAGSPTSTEEGTSESATPESGPGSEPATSGSETP GTSTEPSEGSAPGSEPATSGSETPGTSESATPESGPGTSTEPSEGSAPGTSESATPE SGPGTSTEPSEGSAPGTSTEPSEGSAPGSEPATSGSETPGSPAGSPTSTEEGTSESA TPESGPGTSTEPSEGSAPGSPAGSPTSTEEGTSTEPSEGSAPGTSESATPESGPGTS TEPSEGSAPGTSESATPESGPGSPAGSPTSTEEGTSESATPESGPGSEPATSGSETP GSEPATSGSETPGSEPATSGSETPGTSESATPESGPGTSESATPESGP GTSESATPESGPGTSTEPSEGSAPGTSTEPSEGSAPGSPAGSPTSTEEGSPAGSPTS TEEGTSESATPESGPGSPAGSPTSTEEGSPAGSPTSTEEGTSESATPESGPGTS ESATPESGPGSEPATSGSETPGTSTEPSEGSAPGTSTEPSEGSAPGSPAGSPTSTEE GTSTEPSEGSAPGTSTEPSEGSAPGSEPATSGSETPGSPAGSPTSTEEGTSESATPE SGPGTSTEPSEGSAPGSPAGSPTSTEEGTSESATPESGPGTSESATPESGPGTST | 69 |

TABLE 4-continued

XTEN Polypeptides

| XTEN Name | Amino Acid Sequence | SEQ ID NO: |
|---|---|---|
| AE1140 | GSEPATSGSETPGSEPATSGSETPGTSTEPSEGSAPGSEPATSGSETPGTSESATPE SGPGSEPATSGSETPGSPAGSPTSTEEGTSESATPESGPGSEPATSGSETPGTSTEP SEGSAPGTSESATPESGPGTSESATPESGPGTSTEPSEGSAPGTSTEPSEGSAPGSE PATSGSETPGSPAGSPTSTEEGTSTEPSEGSAPGSEPATSGSETPGSPAGSPTSTEE GTSTEPSEGSAPGTSESATPESGPGSPAGSPTSTEEGTSTEPSEGSAPGTSESATPE SGPGSEPATSGSETPGTSESATPESGPGSEPATSGSETPGTSTEPSEGSAPGTSTEP SEGSAPGTSTEPSEGSAPGSPAGSPTSTEEGSPAGSPTSTEEGTSESATPESGPGTS TEPSEGSAPGTSTEPSEGSAPGSPAGSPTSTEEGSPAGSPTSTEEGSPAGSPTSTEE GTSESATPESGPGSEPATSGSETPGTSESATPESGPGSPAGSPTSTEEGTSTEPSEG SAPGTSESATPESGPGSEPATSGSETPGSPAGSPTSTEEGTSTEPSEGSAPGTSESA TPESGPGTSESATPESGPGSPAGSPTSTEEGTSTEPSEGSAPGSPAGSPTSTEEGSP AGSPTSTEEGTSESATPESGPGSEPATSGSETPGTSTEPSEGSAPGSEPATSGSETP GTSESATPESGPGTSTEPSEGSAPGTSESATPESGPGTSESATPESGPGTSTEPSEG SAPGTSTEPSEGSAPGSEPATSGSETPGTSESATPESGPGTSTEPSEGSAPGSEPAT SGSETPGSPAGSPTSTEEGTSESATPESGPGSPAGSPTSTEEGTSTEPSEGSAPGSE PATSGSETPGSEPATSGSETPGSEPATSGSETPGTSESATPESGPGTSESATPESGP GTSTEPSEGSAPGTSTEPSEGSAPGSEPATSGSETPGTSTEPSEGSAPGTSESATPE SGPGSPAGSPTSTEEGSPAGSPTSTEEGTSTEPSEGSAPGSPAGSPTSTEEGSPA | 70 |
| AE1236 | GSPAGSPTSTEEGTSTEPSEGSAPGSPAGSPTSTEEGTSESATPESGPGSEPATSGS ETPGTSTEPSEGSAPGTSTEPSEGSAPGTSESATPESGPGTSTEPSEGSAPGTSTEP SEGSAPGSEPATSGSETPGSPAGSPTSTEEGTSESATPESGPGSPAGSPTSTEEGTS TEPSEGSAPGSPAGSPTSTEEGTSTEPSEGSAPGSPAGSPTSTEEGTSTEPSEGSAP GSPAGSPTSTEEGSPAGSPTSTEEGSAPGSEPATSGSETPGSPAGSPTS TEEGTSESATPESGPGSEPATSGSETPGSEPATSGSETPGTSESATPESGPGSPAGS PTSTEEGTSESATPESGPGSEPATSGSETPGSEPATSGSETPGTSESATPESGPGTS ESATPESGPGTSTEPSEGSAPGTSTEPSEGSAPGTSESATPESGPGSPAGSPTSTEE GTSTEPSEGSAPGSEPATSGSETPGSPAGSPTSTEEGTSTEPSEGSAPGTSTEPSEG SAPGSPAGSPTSTEEGSPAGSPTSTEEGSPAGSPTSTEEGTSESATPESGPGSEPAT SGSETPGTSESATPESGPGTSESATPESGPGTSTEPSEGSAPGTSESATPESGPGSP AGSPTSTEEGTSESATPESGPGTSESATPESGPGTSTEPSEGSAPGSEPATSGSETP GTSTEPSEGSAPGSPAGSPTSTEEGTSESATPESGPGTSTEPSEGSAPGTSTEPSEG SAPGSEPATSGSETPGSEPATSGSETPGTSESATPESGPGSEPATSGSETPGSPAGS PTSTEEGTSESATPESGPGSEPATSGSETPGTSTEPSEGSAPGTSESATPESGPGTS ESATPESGPGTSTEPSEGSAPGSEPATSGSETPGTSTEPSEGSAPGSPAGSPTSTEE GSPAGSPTSTEEGTSESATPESGPGSEPATSGSETPGSPAGSPTSTEEGSPAGSPTS TEEGTSESATPESGPGSEPATSGSETPGTSTEPSEGSAPGTSTEPSEGSAPGSEP | 71 |
| AE1332 | GSPAGSPTSTEEGTSTEPSEGSAPGTSESATPESGPGTSESATPESGPGSEPATSGS ETPGTSTEPSEGSAPGTSESATPESGPGSPAGSPTSTEEGTSTEPSEGSAPGTSESA TPESGPGSPAGSPTSTEEGTSTEPSEGSAPGTSESATPESGPGTSTEPSEGSAPGSE PATSGSETPGSEPATSGSETPGSEPATSGSETPGTSESATPESGPGSPAGSPTSTEE GTSESATPESGPGSEPATSGSETPGTSESATPESGPGTSESATPESGPGSPAGSPTS TEEGTSTEPSEGSAPGTSESATPESGPGTSTEPSEGSAPGTSTEPSEGSAPGTSTEP SEGSAPGSEPATSGSETPGTSTEPSEGSAPGTSESATPESGPGTSESATPESGPGTS TEPSEGSAPGTSESATPESGPGTSESATPESGPGSEPATSGSETPGTSTEPSEGSAP GTSESATPESGPGSPAGSPTSTEEGSPAGSPTSTEEGTSTEPSEGSAPGSEPATSGS ETPGSEPATSGSETPGTSTEPSEGSAPGSEPATSGSETPGSPAGSPTSTEEGTSESA TPESGPGSEPATSGSETPGSEPATSGSETPGTSESATPESGPGTSESATPESGPGTS TEPSEGSAPGSPAGSPTSTEEGTSESATPESGPGTSTEPSEGSAPGSEPATSGSETP GSPAGSPTSTEEGTSTEPSEGSAPGTSTEPSEGSAPGSEPATSGSETPGTSESATPE SGPGTSTEPSEGSAPGSPAGSPTSTEEGTSESATPESGPGTSESATPESGPGTSTEP SEGSAPGSEPATSGSETPGSEPATSGSETPGTSTEPSEGSAPGTSESATPESGPGSP AGSPTSTEEGTSTEPSEGSAPGTSTEPSEGSAPGSPAGSPTSTEEGSPAGSPTSTEE GTSTEPSEGSAPGSEPATSGSETPGSPAGSPTSTEEGTSESATPESGPGSEPATSGS ETPGSEPATSGSETPGTSESATPESGPGTSESATPESGPGTSTEPSEGSAPGTST | 72 |
| AE1428 | GSEPATSGSETPGSPAGSPTSTEEGTSTEPSEGSAPGSEPATSGSETPGTSESATPE SGPGTSTEPSEGSAPGTSESATPESGPGSPAGSPTSTEEGTSTEPSEGSAPGTSTEP SEGSAPGSPAGSPTSTEEGTSTEPSEGSAPGTSESATPESGPGSEPATSGSETPGTS ESATPESGPGSEPATSGSETPGTSTEPSEGSAPGTSTEPSEGSAPGSEPATSGSETP GTSTEPSEGSAPGTSTEPSEGSAPGSPAGSPTSTEEGTSTEPSEGSAPGTSESATPE SGPGTSTEPSEGSAPGTSTEPSEGSAPGSPAGSPTSTEEGSPAGS PTSTEEGTSTEPSEGSAPGSEPATSGSETPGSPAGSPTSTEEGTSTEPSEGSAPGSP AGSPTSTEEGSPAGSPTSTEEGTSESATPESGPGSEPATSGSETPGSEPATSGSETP GTSTEPSEGSAPGSPAGSPTSTEEGSPAGSPTSTEEGTSESATPESGPGSEPATSGS ETPGSEPATSGSETPGTSESATPESGPGSEPATSGSETPGSEPATSGSETPGTSESA TPESGPGTSESATPESGPGTSESATPESGPGTSESATPESGPGSPAGSPTSTEEGTS TEPSEGSAPGTSESATPESGPGTSTEPSEGSAPGTSTEPSEGSAPGTSESATPESGP GTSESATPESGPGSAPGTSESATPESGPGSPAGSPTSTEEGTSTEPSEGSAPGSATSGS ETPGTSTEPSEGSAPGSEPATSGSETPGTSTEPSEGSAPGTSTEPSEGSAPGSPAGS PTSTEEGTSESATPESGPGTSTEPSEGSAPGSEPATSGSETPGTSESATPESGPGTS ESATPESGPGTSESATPESGPGTSTEPSEGSAPGSEPATSGSETPGSPAGSPTSTEE GTSESATPESGPGTSTEPSEGSAPGTSTEPSEGSAPGSPAGSPTSTEEGTSESATPE SGPGTSTEPSEGSAPGTSTEPSEGSAPGSPAGSPTSTEEGTSESATPESGPGSPA | 73 |

TABLE 4-continued

XTEN Polypeptides

| XTEN Name | Amino Acid Sequence | SEQ ID NO: |
|---|---|---|
| AE1524 | GTSTEPSEGSAPGTSTEPSEGSAPGTSTEPSEGSAPGSPAGSPTS TEEGSPAGSPTSTEEGTSESATPESGPGSEPATSGSETPGTSTEPSEGSAPGTSESA TPESGPGTSTEPSEGSAPGTSESATPESGPGTSESATPESGPGSPAGSPTSTEEGTS TEPSEGSAPGSEPATSGSETPGTSTEPSEGSAPGSPAGSPTSTEEGTSTEPSEGSAP GSPAGSPTSTEEGSPAGSPTSTEEGSPAGSPTSTEEGTSESATPESGPGSEPATSGS ETPGTSESATPESGPGTSESATPESGPGSPAGSPTSTEEGTSTEPSEGSAPGSEPAT SGSETPGTSTEPSEGSAPGSPAGSPTSTEEGSPAGSPTSTEEGTSTEPSEGSAPGSE PATSGSETPGSPAGSPTSTEEGTSESATPESGPGSEPATSGSETPGSPAGSPTSTEE GTSESATPESGPGTSESATPESGPGTSTEPSEGSAPGSEPATSGSETPGSEPATSGS ETPGTSESATPESGPGSEPATSGSETPGTSTEPSEGSAPGSPAGSPTSTEEGTSTEP SEGSAPGSEPATSGSETPGSEPATSGSETPGSPAGSPTSTEEGTSESATPESGPGTS TEPSEGSAPGSPAGSPTSTEEGSPAGSPTSTEEGTSESATPESGPGSPAGSPTSTEE GTSTEPSEGSAPGSEPATSGSETPGSEPATSGSETPGSEPATSGSETPGTSESATPE SGPGTSESATPESGPGTSTEPSEGSAPGTSTEPSEGSAPGSEPATSGSETPGTSTEP SEGSAPGTSESATPESGPGSPAGSPTSTEEGSPAGSPTSTEEGTSTEPSEGSAPGTS ESATPESGPGSPAGSPTSTEEGTSTEPSEGSAPGSPAGSPTSTEEGTSESATPESGP GSEPATSGSETPGTSESATPESGPGSEPATSGSETPGSEPATSGSETPGTSTEPSEG SAPGTSESATPESGPGTSTEPSEGSAPGTSTEPSEGSAPGTSESATPESGPGSPA | 74 |
| AE1620 | GSEPATSGSETPGTSTEPSEGSAPGSEPATSGSETPGTSTEPSEGSAPGTSESATPE SGPGTSESATPESGPGSEPATSGSETPGTSTEPSEGSAPGTSTEPSEGSAPGTSESA TPESGPGTSTEPSEGSAPGTSTEPSEGSAPGSEPATSGSETPGSPAGSPTSTEEGTS ESATPESGPGTSESATPESGPGTSTEPSEGSAPGTSESATPESGPGSEPATSGSETP GTSESATPESGPGTSESATPESGPGTSTEPSEGSAPGTSTEPSEGSAPGSEPATSGS ETPGSPAGSPTSTEEGTSESATPESGPGSEPATSGSETPGSEPATSGSETPGTSESA TPESGPGTSESATPESGPGSPAGSPTSTEEGTSTEPSEGSAPGTSESATPESGPGTS TEPSEGSAPGTSTEPSEGSAPGTSESATPESGPGTSTEPSEGSAPGSPAGSPTSTEE GSPAGSPTSTEEGTSESATPESGPGSEPATSGSETPGSEPATSGSETPGTSTEPSEG SAPGTSESATPESGPGSPAGSPTSTEEGSPAGSPTSTEEGTSTEPSEGSAPGSPAGS PTSTEEGSPAGSPTSTEEGTSESATPESGPGSEPATSGSETPGTSTEPSEGSAPGTS TEPSEGSAPGSEPATSGSETPGSPAGSPTSTEEGTSESATPESGPGSPAGSPTSTEE GTSTEPSEGSAPGTSESATPESGPGSEPATSGSETPGTSESATPESGPGTSESATPE SGPGSPAGSPTSTEEGSPAGSEPATSGSETPGSPAGSPTSTEEGTSTEP SEGSAPGSEPATSGSETPGSEPATSGSETPGTSESATPESGPGTSESATPESGPGTS TEPSEGSAPGTSESATPESGPGSEPATSGSETPGTSESATPESGPGTSESATPESGP GTSTEPSEGSAPGTSESATPESGPGSEPATSGSETPGTSTEPSEGSAPGSPAGSPTS TEEGTSESATPESGPGTSTEPSEGSAPGTSTEPSEGSAPGSPAGSPTSTEEGTST | 75 |
| AE1716 | GTSESATPESGPGTSTEPSEGSAPGTSESATPESGPGTSTEPSEGSAPGSEPATSGS ETPGSPAGSPTSTEEGTSESATPESGPGSEPATSGSETPGSEPATSGSETPGTSESA TPESGPGTSESATPESGPGTSTEPSEGSAPGSEPATSGSETPGSEPATSGSETPGTS ESATPESGPGTSESATPESGPGSEPATSGSETPGTSESATPESGPGSPAGSPTSTEE GSPAGSPTSTEEGTSTEPSEGSAPGSEPATSGSETPGSPAGSPTSTEEGTSESATPE SGPGSPAGSPTSTEEGTSTEPSEGSAPGSEPATSGSETPGSPAGSPTSTEEGTSESA TPESGPGSPAGSPTSTEEGSPAGSPTSTEEGSAPGSEPATSGSETPGSPAGSPTSTEEGSPAGSEPATSGSETPGSP AGSPTSTEEGTSESATPESGPGTSTEPSEGSAPGSPAGSPTSTEEGTSESATPESGP GSEPATSGSETPGTSTEPSEGSAPGSPAGSPTSTEEGTSTEPSEGSAPGTSESATPE SGPGTSESATPESGPGTSTEPSEGSAPGTSTEPSEGSAPGSEPATSGSETPGTSESA TPESGPGTSESATPESGPGTSTEPSEGSAPGTSTEPSEGSAPGSPAGSPTSTEEGSP AGSPTSTEEGTSTEPSEGSAPGSEPATSGSETPGSEPATSGSETPGTSESATPESGP GSPAGSPTSTEEGTSESATPESGPGTSTEPSEGSAPGTSTEPSEGSAPGSPAGSPTS TEEGSPAGSPTSTEEGTSESATPESGPGSPAGSPTSTEEGTSTEPSEGSAPGSEPAT SGSETPGSPAGSPTSTEEGSPAGSPTSTEEGTSTEPSEGSAPGTSESATPESGPGTS ESATPESGPGSPAGSPTSTEEGTSTEPSEGSAPGSPAGSPTSTEEGTSTEPSEGSAP GSPAGSPTSTEEGTSTEPSEGSAPGTSTEPSEGSAPGSEPATSGSETPGSPAGSPTS TEEGTSESATPESGPGSEPATSGSETPGSPAGSPTSTEEGTSESATPESGPGTSE | 76 |
| AE1812 | GTSESATPESGPGSPAGSPTSTEEGSPAGSPTSTEEGTSESATPESGPGSEPATSGS ETPGTSTEPSEGSAPGTSTEPSEGSAPGTSTEPSEGSAPGSPAGSPTSTEEGTSTEP SEGSAPGTSESATPESGPGTSESATPESGPGSPAGSPTSTEEGSPAGSPTSTEEGSP AGSPTSTEEGTSESATPESGPGSEPATSGSETPGTSESATPESGPGTSTEPSEGSAP GTSESATPESGPGTSTEPSEGSAPGTSTEPSEGSAPGTSESATPESGPGSPAGSPTS TEEGTSESATPESGPGTSTEPSEGSAPGSPAGSPTSTEEGTSESATPESGPGSEPAT SGSETPGTSTEPSEGSAPGSEPATSGSETPGSEPATSGSETPGTSESATPESGPGTS ESATPESGPGTSTEPSEGSAPGTSESATPESGPGSPAGSPTSTEEGTSTEPSEGSAP GSEPATSGSETPGTSESATPESGPGSEPATSGSETPGTSTEPSEGSAPGTSESATPE SGPGSPAGSPTSTEEGSPAGSPTSTEEGSPAGSPTSTEEGTSESATPESGPGSEPAT SGSETPGTSESATPESGPGTSESATPESGPGSEPATSGSETPGTSTEPSEGSAPGTS ESATPESGPGTSTEPSEGSAPGTSESATPESGPGSPAGSPTSTEEGTSTEPSEGSAP GSEPATSGSETPGTSTEPSEGSAPGSEPATSGSETPGSPAGSPTSTEEGTSTEPSEG SAPGTSTEPSEGSAPGTSESATPESGPGSEPATSGSETPGTSTEPSEGSAPGTS TEPSEGSAPGTSTEPSEGSAPGTSESATPESGPGSEPATSGSETPGTSESATPESGP GSEPATSGSETPGTSTEPSEGSAPGSEPATSGSETPGSPAGSPTSTEEGSAPGTSESATPE SGPGTSESATPESGPGTSESATPESGPGSPAGSPTSTEEGTSTEPSEGSAPGTSESA TPESGPGTSESATPESGPGTSTEPSEGSAPGTSTEPSEGSAPGSPAGSPTSTEEGTS ESATPESGPGSEPATSGSETPGTSESATPESGPGTSESATPESGPGTSTEPSEGSAP GSEPATSGSETPGTSESATPESGPGSPAGSPTSTEEGTSTEPSEGSAPGSEPATSGS ETPGSPAGSPTSTEEGTSESATPESGPGSPAGSPTSTEEGTSTEPSEGSAPGSEP | 77 |

TABLE 4-continued

XTEN Polypeptides

| XTEN Name | Amino Acid Sequence | SEQ ID NO: |
|---|---|---|
| AE1908 | GSEPATSGSETPGTSTEPSEGSAPGTSESATPESGPGSEPATSGSETPGTSTEPSEG SAPGSPAGSPTSTEEGTSESATPESGPGSPAGSPTSTEEGTSTEPSEGSAPGSEPAT SGSETPGTSTEPSEGSAPGTSESATPESGPGSEPATSGSETPGSEPATSGSETPGTS ESATPESGPGTSTEPSEGSAPGTSESATPESGPGTSESATPESGPGSPAGSPTSTEE GSPAGSPTSTEEGTSESATPESGPGTSESATPESGPGTSTEPSEGSAPGTSTEPSEG SAPGSPAGSPTSTEEGTSTEPSEGSAPGSEPATSGSETPGSEPATSGSETPGSEPAT SGSETPGSEPATSGSETPGTSESATPESGPGTSESATPESGPGTSESATPESGPGTS TEPSEGSAPGTSESATPESGPGTSESATPESGPGTSTEPSEGSAPGSPAGSPTSTEE GTSTEPSEGSAPGSEPATSGSETPGSPAGSPTSTEEGTSESATPESGPGTSTEPSEG SAPGSEPATSGSETPGTSESATPESGPGTSESATPESGPGTSTEPSEGSAPGSEPAT SGSETPGSPAGSPTSTEEGTSESATPESGPGTSESATPESGPGTSTEPSEGSAPGSE PATSGSETPGSPAGSPTSTEEGTSESATPESGPGSEPATSGSETPGTSTEPSEGSAP GSEPATSGSETPGSPAGSPTSTEEGTSESATPESGPGTSTEPSEGSAPGSEPATSGS ETPGTSESATPESGPGTSESATPESGPGSPAGSPTSTEEGTSTEPSEGSAPGSPAGS PTSTEEGSPAGSPTSTEEGSPAGSPTSTEEGTSESATPESGPGSEPATSGSETPGTS TEPSEGSAPGTSTEPSEGSAPGTSESATPESGPGTSTEPSEGSAPGTSESATPESGP GSEPATSGSETPGTSTEPSEGSAPGTSESATPESGPGSPAGSPTSTEEGSPAGSPTS TEEGSPAGSPTSTEEGTSESATPESGPGSPAGSPTSTEEGTSESATPESGPGSEP | 78 |
| AE2004A | GTSTEPSEGSAPGSEPATSGSETPGTSTEPSEGSAPGTSTEPSEGSAPGSEPATSGS ETPGSPAGSPTSTEEGSPAGSPTSTEEGTSESATPESGPGSEPATSGSETPGTSTEP SEGSAPGTSTEPSEGSAPGSPAGSPTSTEEGTSESATPESGPGTSESATPESGPGSP AGSPTSTEEGTSTEPSEGSAPGTSESATPESGPGTSTEPSEGSAPGSEPATSGSETP GTSESATPESGPGSEPATSGSETPGTSTEPSEGSAPGTSTEPSEGSAPGSPAGSPTS TEEGSPAGSPTSTEEGTSESATPESGPGSPAGSPTSTEEGTSTEPSEGSAPGSEPAT SGSETPGSEPATSGSETPGSPAGSPTSTEEGTSESATPESGPGTSTEPSEGSAPGSE PATSGSETPGTSESATPESGPGSEPATSGSETPGSPAGSPTSTEEGTSESATPESGP GTSESATPESGPGSEPATSGSETPGTSESATPESGPGTSESATPESGPGTSESATPE SGPGTSTEPSEGSAPGTSESATPESGPGSEPATSGSETPGTSTEPSEGSAPGSPAGS PTSTEEGTSTEPSEGSAPGSEPATSGSETPGSPAGSPTSTEEGTSESATPESGPGTS ESATPESGPGTSTEPSEGSAPGTSESATPESGPGTSTEPSEGSAPGTSESATPESGP GSEPATSGSETPGTSTEPSEGSAPGTSTEPSEGSAPGSPAGSPTSTEEGSPAGSPTS TEEGTSESATPESGPGTSTEPSEGSAPGTSESATPESGPGSPAGSPTSTEEGSPAGS PTSTEEGSPAGSPTSTEEGTSTEPSEGSAPGSPAGSPTSTEEGSPAGSPTSTEEGTS ESATPESGPGSEPATSGSETPGSEPATSGSETPGTSESATPESGPGSEPATSGSETP GTSESATPESGPGTSTEPSEGSAPGTSTEPSEGSAPGSPAGSPTSTEEGSPAGSPTS TEEGTSESATPESGPGSPAGSPTSTEEGTSTEPSEGSAPGTSESATPESGPGTSE | 79 |
| AG948 | GSSTPSGATGSPGTPGSGTASSSPGASPGTSSTGSPGSSPSASTGTGPGTPGSGTA SSSPGTPGSGTASSSPGTPGSGTASSSPGSSPSASTGTGPGTPGSGTASSSPGSSPS ASTGTGPGSSTPSGATGSPGSSTPSGATGSPGSSPSASTGTGPGSSTPSGATGSPG ASPGTSSTGSPGASPGTSSTGSPGSSPSASTGTGPGSSPSASTGTGPGASPGTSST GSPGSSPSASTGTGPGASPGTSSTGSPGSSPSASTGTGPGASPGTSSTGSPGTPGS GTASSSPGTPGSGTASSSPGSSTPSGATGSPGSSTPSGATGSPGSSTPSGATGSPG ASPGTSSTGSPGSSPSASTGTGPGASPGTSSTGSPGASPGTSSTGSPGSSTPSGAT GSPGSSPSASTGTGPGSSPSASTGTGPGTPGSGTASSSPGASPGTSSTGSPGTPGS GTASSSPGSSTPSGATGSPGSSTPSGATGSPGSSPSASTGTGPGSSPSASTGTGPG SSTPSGATGSPGASPGTSSTGSPGTPGSGTASSSPGSSPSASTGTGPGSSTPSGAT GSPGASPGTSSTGSPGSSTPSGATGSPGTPGSGTASSSPGSSPSASTGTGPGSSTPS GATGSPGASPGTSSTGSPGASPGTSSTGSPGTPGSGTASSSPGTPGSGTASSSPGS SPSASTGTGPGASPGTSSTGSPGASPGTSSTGSPGTPGSGTASSSPGTPGSGTASS SPGSSTPSGATGSPGSSPSASTGTGPGSSTPSGATGSPGSSPSASTGTGPGSSPSAS TGTGPGTPGSGTASSSPGSSTPSGATGSPGASPGTSSTGSPGTPGSGTASSSPGTP GSGTASSSPGSSTPSGATGSPGTPGSGTASSSPGASPGTSSTGSPGSSTPSGATGS PGSSTPSGATGSPGTPGSGTASSSPGSSTPSGATGSPGSSTPSGATGSP | 80 |
| AG1044 | GTPGSGTASSSPGTPGSGTASSSPGSSPSASTGTGPGTPGSGTASSSPGASPGTSS TGSPGTPGSGTASSSPGSSPSASTGTGPGSSTPSGATGSPGASPGTSSTGSPGASP GTSSTGSPGSSPSASTGTGPGSSTPSGATGSPGSSPSASTGTGPGSSPSASTGTGP GTPGSGTASSSPGTPGSGTASSSPGASPGTSSTGSPGSSTPSGATGSPGSSPSAST GTGPGTPGSGTASSSPGASPGTSSTGSPGTPGSGTASSSPGSSPSASTGTGPGSSP SASTGTGPGASPGTSSTGSPGASPGTSSTGSPGSSTPSGATGSPGSSTPSGATGSP GTPGSGTASSSPGSSPSASTGTGPGSSTPSGATGSPGASPGTSSTGSPGSSTPSGA TGSPGSSTPSGATGSPGSSPSASTGTGPGASPGTSSTGSPGTPGSGTASSSPGASP GTSSTGSPGSSPSASTGTGPGTPGSGTASSSPGASPGTSSTGSPGASPGTSSTGSP GSSTPSGATGSPGTPGSGTASSSPGSSTPSGATGSPGASPGTSSTGSPGTPGSGTA SSSPGTPGSGTASSSPGSSTPSGATGSPGSSTPSGATGSPGTPGSGTASSSPGSSTP SGATGSPGSSTPSGATGSPGASPGTSSTGSPGSSPSASTGTGPGSSPSASTGTGPG ASPGTSSTGSPGASPGTSSTGSPGTPGSGTASSSPGSSPSASTGTGPGTPGSGTAS SSPGSSTPSGATGSPGSSTPSGATGSPGASPGTSSTGSPGSSPSASTGTGPGASPG TSSTGSPGSSPSASTGTGPGSSPSASTGTGPGASPGTSSTGSPGASPGTSSTGSPGS STPSGATGSPGASPGTSSTGSPGASPGTSSTGSPGTPGSGTASSSPGTPGSGTASS SPGTPGSGTASSSPGSSTPSGATGSPGSSTPSGATGSPGSSPSASTGTGPGSSPSAS TGTGPGTPGSGTASSSPGSSPSASTGTGPGASPGTSSTGSPGSSTPSGATGSPGTP GSGTASSSPGSST | 81 |

TABLE 4-continued

XTEN Polypeptides

| XTEN Name | Amino Acid Sequence | SEQ ID NO: |
|---|---|---|
| AG1140 | GASPGTSSTGSPGSSPSASTGTGPGSSTPSGATGSPGASPGTSSTGSPGASPGTSS TGSPGSSTPSGATGSPGPTPGSGTASSSPGASPGTSSTGSPGTPGSGTASSSPGTPG SGTASSSPGSSTPSGATGSPGSSTPSGATGSPGTPGSGTASSSPGSSTPSGATGSP GSSTPSGATGSPGSSPSASTGTGPGSSPSASTGTGPGASPGTSSTGSPGTPGSGTA SSSPGASPGTSSTGSPGSSTPSGATGSPGPTPGSGTASSSPGSSPSASTGTGPGSSTP SGATGSPGSSPSASTGTGPGSSTPSGATGSPGASPGTSSTGSPGSSPSASTGTGPG TPGSGTASSSPGASPGTSSTGSPGSSTPSGATGSPGASPGTSSTGSPGSSPSASTGT GPGTPGSGTASSSPGTPGSGTASSSPGASPGTSSTGSPGTPGSGTASSSPGTPGSG TASSSPGSSPSASTGTGPGASPGTSSTGSPGSSTPSGATGSPGASPGTSSTGSPGSS PSASTGTGPGTPGSGTASSSPGSSPSASTGTGPGSSPSASTGTGPGASPGTSSTGS PGASPGTSSTGSPGTPGSGTASSSPGASPGTSSTGSPGASPGTSSTGSPGTPGSGT ASSSPGTPGSGTASSSPGSSTPSGATGSPGSSTPSGATGSPGPTPGSGTASSSPGSSP SASTGTGPGTPGSGTASSSPGSSTPSGATGSPGSSTPSGATGSPGASPGTSSTGSP GTPGSGTASSSPGASPGTSSTGSPGSSTPSGATGSPGSSTPSGATGSPGTPGSGTA SSSPGSSTPSGATGSPGSSTPSGATGSPGASPGTSSTGSPGSSPSASTGTGPGSSTP SGATGSPGSSTPSGATGSPGSSPSASTGTGPGSSPSASTGTGPGSSTPSGATGSPG ASPGTSSTGSPGSSPSASTGTGPGTPGSGTASSSPGASPGTSSTGSPGSSPSASTGT GPGASPGTSSTGSPGSSTPSGATGSPGSSPSASTGTGPGSSPSASTGTGPGASPGT SSTGSPGSST | 82 |
| AG1236 | GSSPSASTGTGPGTPGSGTASSSPGSSPSASTGTGPGSSPSASTGTGPGTPGSGTA SSSPGASPGTSSTGSPGSSTPSGATGSPGPTPGSGTASSSPGASPGTSSTGSPGTPGS GTASSSPGTPGSGTASSSPGSSPSASTGTGPGSSPSASTGTGPGSSTPSGATGSPG ASPGTSSTGSPGSSPSASTGTGPGTPGSGTASSSPGTPGSGTASSSPGSSTPSGAT GSPGASPGTSSTGSPGSSPSASTGTGPGTPGSGTASSSPGTPGSGTASSSPGASPG TSSTGSPGSSTPSGATGSPGSSPSASTGTGPGSSPSASTGTGPGASPGTSSTGSPGASPGTSST GSPGSSTPSGATGSPGSSPSASTGTGPGASPGTSSTGSPGASPGTSSTGSPGTPGS GTASSSPGSSTPSGATGSPGASPGTSSTGSPGSSTPSGATGSPGTPGSGTASSSPG SSPSASTGTGPGSSTPSGATGSPGTPGSGTASSSPGSSTPSGATGSPGSSTPSGAT GSPGASPGTSSTGSPGSSPSASTGTGPGSSPSASTGTGPGASPGTSSTGSPGSSPSA STGTGPGTPGSGTASSSPGTPGSGTASSSPGASPGTSSTGSPGTPGSGTASSSPGA SPGTSSTGSPGTPGSGTASSSPGASPGTSSTGSPGSSTPSGATGSPGASPGTSSTGS PGSSPSASTGTGPGTPGSGTASSSPGTPGSGTASSSPGSSPSASTGTGPGTPGSGT ASSSPGASPGTSSTGSPGSSTPSGATGSPGTPGSGTASSSPGASPGTSSTGSPGTP GSGTASSSPGTPGSGTASSSPGSSTPSGATGSPGTPGSGTASSSPGSSSPSASTGTG PGSSTPSGATGSPGTPGSGTASSSPGSSTPSGATGSPGSSTPSGATGSPGSSPSAST GTGPGASPGTSSTGSPGTPGSGTASSSPGSSPSASTGTGPGSSPSASTGTGPGASP GTSSTGSPGASP | 83 |
| AG1332 | GSSTPSGATGSPGSSPSASTGTGPGTPGSGTASSSPGSSPSASTGTGPGASPGTSS TGSPGSSPSASTGTGPGTPGSGTASSSPGASPGTSSTGSPGSSTPSGATGSPGSSPS ASTGTGPGSSTPSGATGSPGASPGTSSTGSPGTPGSGTASSSPGASPGTSSTGSPG SSTPSGATGSPGSSTPSGATGSPGSSPSASTGTGPGTPGSGTASSSPGSSTPSGAT GSPGSSTPSGATGSPGASPGTSSTGSPGASPGTSSTGSPGTPGSGTASSSPGTPGSGTASSSPG SSTPSGATGSPGSSTPSGATGSPGSSTPSGATGSPGASPGTSSTGSPGSSPSASTGT GPGSSTPSGATGSPGSSPSASTGTGPGSSTPSGATGSPGTPGSGTASSSPGSSPSAS TGTGPGSSTPSGATGSPGASPGTSSTGSPGASPGTSSTGSPGSSPSASTGTGPGAS PGTSSTGSPGSSTPSGATGSPGASPGTSSTGSPGTPGSGTASSSPGTPGSGTASSSP GSSSPSASTGTGPGTPGSGTASSSPGSSTPSGATGSPGSSPSASTGTGPGSSTPSGA TGSPGTPGSGTASSSPGTPGSGTASSSPGSSPSASTGTGPGSSTPSGATGSPGSSTP SGATGSPGSSPSASTGTGPGSSPSASTGTGPGASPGTSSTGSPGASPGTSSTGSPG SSTPSGATGSPGASPGTSSTGSPGSSPSASTGTGPGTPGSGTASSSPGASPGTSST GSPGASPGTSSTGSPGTPGSGTASSSPGTPGSGTASSSPGSSPSASTGTGPGTPGS GTASSSPGASPGTSSTGSPGSSTPSGATGSPGTPGSGTASSSPGTPGSGTASSSPG SSTPSGATGSPGSSTPSGATGSPGTPGSGTASSSPGSSPSASTGTGPGSSPSASTGT GPGASPGTSSTGSPGSSPSASTGTGPGSSPSASTGTGPGASPGTSSTGSPGASPGT SSTGSPGTPG | 84 |
| AG1428 | GTPGSGTASSSPGSSTPSGATGSPGASPGTSSTGSPGSSTPSGATGSPGTPGSGTA SSSPGTPGSGTASSSPGSSTPSGATGSPGSSTPSGATGSPGASPGTSSTGSPGSSPS ASTGTGPGSSTPSGATGSPGASPGTSSTGSPGSSPSASTGTGPGTPGSGTASSSPG ASPGTSSTGSPGASPGTSSTGSPGTPGSGTASSSPGTPGSGTASSSPGASPGTSST GSPGASPGTSSTGSPGTPGSGTASSSPGTPGSGTASSSPGSSPSASTGTGPGSSPSA STGTGPGASPGTSSTGSPGSSPSASTGTGPGSSPSASTGTGPGASPGTSSTGSPGA SPGTSSTGSPGTPGSGTASSSPGTPGSGTASSSPGSSPSASTGTGPGASPGTSSTGS PGSSTPSGATGSPGASPGTSSTGSPGSSPSASTGTGPGSSTPSGATGSPGSSPSAST GTGPGSSPSASTGTGPGASPGTSSTGSPGSSPSASTGTGPGSSPSASTGTGPGASP GTSSTGSPGASPGTSSTGSPGSSPSASTGTGPGTPGSGTASSSPGASPGTSSTGSP GSSTPSGATGSPGTPGSGTASSSPGTPGSGTASSSPGSSPSASTGTGPGSSTPSGA TGSPGASPGTSSTGSPGASPGTSSTGSPGSSTPSGATGSPGSSPSASTGTGPGASP GTSSTGSPGSSTPSGATGSPGTPGSGTASSSPGASPGTSSTGSPGTPGSGTASSSP GASPGTSSTGSPGSSTPSGATGSPGSSTPSGATGSPGASPGTSSTGSPGSSPSAST | 85 |

TABLE 4-continued

XTEN Polypeptides

| XTEN Name | Amino Acid Sequence | SEQ ID NO: |
|---|---|---|
| | GTGPGTPGSGTASSSPGTPGSGTASSSPGSSTPSGATGSPGTPGSGTASSSPGASP GTSSTGSPGSSTPSGATGSPGTPGSGTASSSPGSSPSASTGTGPGSSTPSGATGSP GSSTPSGATGSPGSSPSASTGTGPGSSTPSGATGSPGTPGSGTASSSPGSSPSAST GTGPGTPGSGTASSSPGSSTPSGATGSPGSSPSASTGTGPGSSPSASTGTGPGTPG SGTASSSPGASP | |
| AG1524 | GSSTPSGATGSPGTPGSGTASSSPGTPGSGTASSSPGASPGTSSTGSPGSSTPSGA TGSPGTPGSGTASSSPGSSTPSGATGSPGSSPSASTGTGPGSSTPSGATGSPGTPG SGTASSSPGTPGSGTASSSPGSSPSASTGTGPGSSTPSGATGSPGSSPSASTGTGP GTPGSGTASSSPGASPGTSSTGSPGSSTPSGATGSPGASPGTSSTGSPGTPGSGTA SSSPGSSTPSGATGSPGTPGSGTASSSPGSSPSASTGTGPGASPGTSSTGSPGASPG TSSTGSPGTPGSGTASSSPGSSTPSGATGSPGSSTPSGATGSPGSSPSASTGTGPGS SPSASTGTGPGASPGTSSTGSPGTPGSGTASSSPGTPGSGTASSSPGSSPSASTGT GPGASPGTSSTGSPGASPGTSSTGSPGTPGSGTASSSPGSSPSASTGTGPGASPGT SSTGSPGASPGTSSTGSPGSSTPSGATGSPGSSPSASTGTGPGSSPSASTGTGPGTP GSGTASSSPGTPGSGTASSSPGASPGTSSTGSPGSSTPSGATGSPGTPGSGTASSS PGASPGTSSTGSPGTPGSGTASSSPGTPGSGTASSSPGSSTPSGATGSPGSSTPSG ATGSPGTPGSGTASSSPGSSPSASTGTGPGSSTPSGATGSPGSSTPSGATGSPGSS PSASTGTGPGTPGSGTASSSPGSSPSASTGTGPGASPGTSSTGSPGSSPSASTGTG PGTPGSGTASSSPGASPGTSSTGSPGASPGTSSTGSPGTPGSGTASSSPGTPGSGT ASSSPGSSTPSGATGSPGTPGSGTASSSPGASPGTSSTGSPGSSTPSGATGSPGSST PSGATGSPGSSTPSGATGSPGTPGSGTASSSPGSSPSASTGTGPGSSPSASTGTGP GSSPSASTGTGPGASPGTSSTGSPGASPGTSSTGSPGSSPSASTGTGPGTPGSGTA SSSPGASPGTSSTGSPGSSTPSGATGSPGASPGTSSTGSPGASPGTSSTGSPGSSTP SGATGSPGTPG | 86 |
| AG1620 | GSSTPSGATGSPGSSTPSGATGSPGTPGSGTASSSPGSSPSASTGTGPGTPGSGTA SSSPGASPGTSSTGSPGSSTPSGATGSPGASPGTSSTGSPGTPGSGTASSSPGASPG TSSTGSPGSSPSASTGTGPGTPGSGTASSSPGASPGTSSTGSPGSSTPSGATGSPGS SPSASTGTGPGSSTPSGATGSPGASPGTSSTGSPGASPGTSSTGSPGASPGTSSTG SPGSSTPSGATGSPGASPGTSSTGSPGTPGSGTASSSPGSSTPSGATGSPGSSTPSG ATGSPGSSPSASTGTGPGSSPSASTGTGPGSSTPSGATGSPGSSPSASTGTGPGSS PSASTGTGPGASPGTSSTGSPGASPGTSSTGSPGTPGSGTASSSPGSSPSASTGTG PGSSPSASTGTGPGASPGTSSTGSPGSSPSASTGTGPGTPGSGTASSSPGSSPSAST GTGPGSSTPSGATGSPGASPGTSSTGSPGSSTPSGATGSPGTPGSGTASSSPGSSP SASTGTGPGASPGTSSTGSPGSSTPSGATGSPGASPGTSSTGSPGASPGTSSTGSP GTPGSGTASSSPGASPGTSSTGSPGASPGTSSTGSPGSSTPSGATGSPGTPGSGTA SSSPGSSPSASTGTGPGSSTPSGATGSPGTPGSGTASSSPGSSTPSGATGSPGSSTP SGATGSPGSSPSASTGTGPGSSPSASTGTGPGSSTPSGATGSPGASPGTSSTGSPG SSPSASTGTGPGTPGSGTASSSPGASPGTSSTGSPGSSPSASTGTGPGSSTPSGAT GSPGSSPSASTGTGPGSSTPSGATGSPGSSPSASTGTGPGTPGSGTASSSPGTPGS GTASSSPGSSTPSGATGSPGSSTPSGATGSPGTPGSGTASSSPGSSPSASTGTGPG SSTPSGATGSPGSSPSASTGTGPGSSPSASTGTGPGSSTPSGATGSPGASPGTSST GSPGASPGTSSTGSPGTPGSGTASSSPGTPGSGTASSSPGTPGSGTASSSPGSSTPS GATGSPGSST | 87 |
| AG1716 | GASPGTSSTGSPGSSPSASTGTGPGSSTPSGATGSPGSSPSASTGTGPGTPGSGTA SSSPGSSTPSGATGSPGSSTPSGATGSPGSSPSASTGTGPGSSTPSGATGSPGTPGS GTASSSPGSSPSASTGTGPGSSTPSGATGSPGASPGTSSTGPGSSPSASTGTGPG SSPSASTGTGPGTPGSGTASSSPGASPGTSSTGSPGSSTPSGATGSPGSSPSASTGT GPGASPGTSSTGSPGSSTPSGATGSPGTPGSGTASSSPGSSPSASTGTGPGSSPSAS TGTGPGSSPSASTGTGPGTPGSGTASSSPGTPGSGTASSSPGSSTPSGATGSPGTP GSGTASSSPGSSPSASTGTGPGASPGTSSTGSPGASPGTSSTGSPGTPGSGTASSS PGSSPSASTGTGPGASPGTSSTGSPGTPGSGTASSSPGSSTPSGATGSPGSSTPSG ATGSPGASPGTSSTGSPGTPGSGTASSSPGSSPSASTGTGPGTPGSGTASSSPGAS PGTSSTGSPGSSTPSGATGSPGASPGTSSTGSPGASPGTSSTGSPGTPGSGTASSSP GTPGSGTASSSPGSSPSASTGTGPGSSPSASTGTGPGSSPSASTGTGPGTPGSGTA SSSPGASPGTSSTGSPGSSTPSGATGSPGASPGTSSTGSPGASPGTSSTGPGASPG TSSTGSPGSSPSASTGTGPGASPGTSSTGSPGSSPSASTGTGPGSSPSASTGTGPGT PGSGTASSSPGASPGTSSTGSPGTPGSGTASSSPGTPGSGTASSSPGASPGTSSTG SPGSSTPSGATGSPGSSTPSGATGSPGSSPSASTGTGPGSSTPSGATGSPGTPGSG TASSSPGSSPSASTGTGPGSSTPSGATGSPGSSTPSGATGSPGSSPSASTGTGPGSS PSASTGTGPGASPGTSSTGSPGTPGSGTASSSPGSSPSASTGTGPGSSTPSGATGS PGASPGTSSTGSPGASPGTSSTGSPGSSPSASTGTGPGASPGTSSTGSPGASPGTS STGSPGTPG | 88 |
| AG1812 | GSSTPSGATGSPGSSPSASTGTGPGASPGTSSTGSPGASPGTSSTGSPGTPGSGTA SSSPGSSPSASTGTGPGASPGTSSTGSPGSSTPSGATGSPGSSTPSGATGSPGASPG TSSTGSPGSSPSASTGTGPGTPGSGTASSSPGTPGSGTASSSPGASPGTSSTGSPGS STPSGATGSPGSSTPSGATGSPGASPGSSPSASTGTGPGTPGSGTASSSPGTPGSSTG SPGSSTPSGATGSPGTPGSGTASSSPGSSPSASTGTGPGSSTPSGATGSPGTPGSG TASSSPGSSPSASTGTGPGTPGSGTASSSPGASPGTSSTGSPGSSTPSGATGSPGSS TPSGATGSPGTPGSGTASSSPGSSTPSGATGSPGSSTPSGATGSPGASPGTSSTGS PGASPGTSSTGSPGSSTPSGATGSPGTPGSGTASSSPGSSPSAST GTGPGTPGSGTASSSPGASPGTSSTGSPGTPGSGTASSSPGASPGTSSTGSPGSST | 89 |

TABLE 4-continued

XTEN Polypeptides

| XTEN Name | Amino Acid Sequence | SEQ ID NO: |
|---|---|---|
| | PSGATGSPGSSPSASTGTGPGSSPSASTGTGPGTPGSGTASSSPGASPGTSSTGSP GASPGTSSTGPGTPGSGTASSSPGASPGTSSTGSPGSSTPSGATGSPGSSTPSGA TGSPGSSPSASTGTGPGASPGTSSTGSPGASPGTSSTGSPGTPGSGTASSSPGTPG SGTASSSPGSSTPSGATGSPGSSPSASTGTGPGSSPSASTGTGPGASPGTSSTGSP GASPGTSSTGPGSSTPSGATGSPGSSPSASTGTGPGASPGTSSTGSPGSSTPSGA TGSPGTPGSGTASSSPGSSPSASTGTGPGASPGTSSTGSPGSSTPSGATGSPGTPG SGTASSSPGSSTPSGATGSPGSSTPSGATGSPGSSTPSGATGSPGSSPSASTGTGP GSSPSASTGTGPGSSTPSGATGSPGSSPSASTGTGPGSSPSASTGTGPGSSTPSGA TGSPGASPGTSSTGSPGASPGTSSTGSPGTPGSGTASSSPGASPGTSSTGSPGSSTP SGATGSPGASP | |
| AG1908 | GSSPSASTGTGPGSSPSASTGTGPGSSPSASTGTGPGTPGSGTASSSPGSSPSAST GTGPGSSPSASTGTGPGASPGTSSTGSPGSSPSASTGTGPGTPGSGTASSSPGTPG SGTASSSPGASPGTSSTGSPGTPGSGTASSSPGTPGSGTASSSPGSSPSASTGTGP GSSTPSGATGSPGSSPSASTGTGPGASPGTSSTGSPGSSPSASTGTGPGASPGTSS TGSPGASPGTSSTGSPGTPGSGTASSSPGTPGSGTASSSPGASPGTSSTGSPGTPG SGTASSSPGTPGSGTASSSPGSSPSASTGTGPGSSTPSGATGSPGASPGTSSTGSP GSSTPSGATGSPGSSPSASTGTGPGSSPSASTGTGPGSSTPSGATGSPGASPGTSS TGSPGSSPSASTGTGPGTPGSGTASSSPGASPGTSSTGSPGASPGTSSTGSPGTPG SGTASSSPGTPGSGTASSSPGSSTPSGATGSPGTPGSGTASSSPGSSPSASTGTGPGSSTPSGA TGSPGASPGTSSTGSPGASPGTSSTGSPGTPGSGTASSSPGTPGSGTASSSPGSSTP SGATGSPGSSPSASTGTGPGSSPSASTGTGPGASPGTSSTGSPGASPGTSSTGSPG SSTPSGATGSPGASPGTSSTGSPGASPGTSSTGSPGTPGSGTASSSPGTPGSGTAS SSPGTPGSGTASSSPGSSTPSGATGSPGSSTPSGATGSPGSSPSASTGTGPGSSPSA STGTGPGSSTPSGATGSPGTPGSGTASSSPGSSPSASTGTGPGASPGTSSTGSPGS STPSGATGSPGSSPSASTGTGPGSSTPSGATGSPGASPGTSSTGSPGSSPSASTGT GPGTPGSGTASSSPGSSPSASTGTGPGSSTPSGATGSPGASPGTSSTGSPGSSPSAS TGTGPGTPGSGTASSSPGSSTPSGATGSPGSSTPSGATGSPGASPGTSSTGSPGSS PSASTGTGPGSSP | 90 |
| AG2004A | GSSPSASTGTGPGTPGSGTASSSPGSSTPSGATGSPGTPGSGTASSSPGSSTPSGA TGSPGSSTPSGATGSPGSSPSASTGTGPGSSPSASTGTGPGSSPSASTGTGPGTPG SGTASSSPGASPGTSSTGSPGSSTPSGATGSPGTPGSGTASSSPGTPGSGTASSSP GSSTPSGATGSPGSSTPSGATGSPGSSPSASTGTGPGASPGTSSTGSPGASPGTSS TGSPGASPGTSSTGSPGASPGTSSTGSPGTPGSGTASSSPGTPGSGTASSSPGSSPS ASTGTGPGSSTPSGATGSPGASPGTSSTGSPGSSTPSGATGSPGSSTPSGATGSPG SSPSASTGTGPGASPGTSSTGSPGTPGSGTASSSPGSSPSASTGTGPGSSPSASTGT GPGASPGTSSTGSPGASPGTSSTGSPGTPGSGTASSSPGASPGTSSTGSPGTPGSG TASSSPGTPGSGTASSSPGSSTPSGATGSPGTPGSGTASSSPGASPGTSSTGSPGSS TPSGATGSPGSSTPSGATGSPGSSPSASTGTGPGSSTPSGATGSPGSSTPSGATGS PGASPGTSSTGSPGSSPSASTGTGPGTPGSGTASSSPGASPGTSSTGSPGSSPSAST GTGPGTPGSGTASSSPGSSPSASTGTGPGTPGSGTASSSPGASPGTSSTGSPGASP GTSSTGSPGTPGSGTASSSPGTPGSGTASSSPGSSTPSGATGSPGSSTPSGATGSP GTPGSGTASSSPGSSTPSGATGSPGSSTPSGATGSPGASPGTSSTGSPGSSPSAST GTGPGSSTPSGATGSPGSSPSASTGTGPGSSPSASTGTGPGASPGTSSTGSPGSST PSGATGSPGASPGTSSTGSPGTPGSGTASSSPGTPGSGTASSSPGSSPSASTGTGP GASPGTSSTGSPGSSTPSGATGSPGSSPSASTGTGPGSSPSASTGTGPGASPGTSS TGSPGTPGSGTASSSPGSSTPSGATGSPGTPGSGTASSSPGSSPSASTGTGPGSSPS ASTGTGPGASP | 91 |
| AE72B | SPAGSPTSTEEGSPAGSPTSTEEGTSESATPESGPGTSTEPSEGSAPGTSESATPES GPGSEPATSGSETPG | 92 |
| AE72C | TSESATPESGPGTSESATPESGPGSEPATSGSETPGSEPATSGSETPGSPAGSPTST EEGTSTEPSEGSAPG | 93 |
| AE108A | TEEGTSESATPESGPGTSTEPSEGSAPGSPAGSPTSTEEGTSTEPSEGSAPGTSTEP SEGSAPGTSESATPESGPGSEPATSGSETPGSEPATSGSETPGSPAGSPTS | 94 |
| AE108B | GSPAGSPTSTEEGTSTEPSEGSAPGTSESATPESGPGTSESATPESGPGTSESATPE SGPGSEPATSGSETPGSEPATSGSETPGSPAGSPTSTEEGTSTEPSEGSAP | 95 |
| AE144A | STEPSEGSAPGSPAGSPTSTEEGTSTEPSEGSAPGTSESATPESGPGSEPATSGSET PGTSESATPESGPGSEPATSGSETPGTSESATPESGPGTSTEPSEGSAPGTSESATP ESGPGSPAGSPTSTEEGSPAGSPTSTEEGS | 96 |
| AE144B | SEPATSGSETPGTSESATPESGPGSEPATSGSETPGTSESATPESGPGTSTEPSEGS APGSPAGSPTSTEEGTSESATPESGPGSEPATSGSETPGTSESATPESGPGSPAGSP TSTEEGSPAGSPTSTEEGTSTEPSEGSAPG | 97 |
| AE180A | TSTEEGTSESATPESGPGSEPATSGSETPGTSESATPESGPGSPAGSPTSTEEGSPA GSPTSTEEGTSTEPSEGSAPGTSESATPESGPGTSESATPESGPGTSESATPESGPG SEPATSGSETPGSEPATSGSETPGSPAGSPTSTEEGTSTEPSEGSAPGTSTEPSEGS APGSEPATS | 98 |

TABLE 4-continued

XTEN Polypeptides

| XTEN Name | Amino Acid Sequence | SEQ ID NO: |
|---|---|---|
| AE216A | PESGPGTSTEPSEGSAPGSPAGSPTSTEEGTSESATPESGPGSEPATSGSETPGTSE SATPESGPGSPAGSPTSTEEGSPAGSPTSTEEGTSTEPSEGSAPGTSESATPESGPG TSESATPESGPGTSESATPESGPGSEPATSGSETPGSEPATSGSETPGSPAGSPTST EEGTSTEPSEGSAPGTSTEPSEGSAPGSEPATSGSETPGTSESAT | 99 |
| AE252A | ESGPGSEPATSGSETPGTSESATPESGPGTSTEPSEGSAPGSPAGSPTSTEEGTSES ATPESGPGSEPATSGSETPGTSESATPESGPGSPAGSPTSTEEGSPAGSPTSTEEGT STEPSEGSAPGTSESATPESGPGTSESATPESGPGTSESATPESGPGSEPATSGSET PGSEPATSGSETPGSPAGSPTSTEEGTSTEPSEGSAPGTSTEPSEGSAPGSEPATSG SETPGTSESATPESGPGTSTEPSE | 100 |
| AE288A | TPESGPGTSTEPSEGSAPGTSESATPESGPGSEPATSGSETPGTSESATPESGPGSE PATSGSETPGTSESATPESGPGTSTEPSEGSAPGSPAGSPTSTEEGTSESATPESGP GSEPATSGSETPGTSESATPESGPGSPAGSPTSTEEGSPAGSPTSTEEGTSTEPSEG SAPGTSESATPESGPGTSESATPESGPGTSESATPESGPGSEPATSGSETPGSEPAT SGSETPGSPAGSPTSTEEGTSTEPSEGSAPGTSTEPSEGSAPGSEPATSGSETPGTS ESA | 101 |
| AE324A | PESGPGSPAGSPTSTEEGSPAGSPTSTEEGSPAGSPTSTEEGTSESATPESGPGTST EPSEGSAPGTSESATPESGPGSEPATSGSETPGTSESATPESGPGSEPATSGSETPG TSESATPESGPGTSTEPSEGSAPGSPAGSPTSTEEGTSESATPESGPGSEPATSGSE TPGTSESATPESGPGSPAGSPTSTEEGSPAGSPTSTEEGTSTEPSEGSAPGTSESAT PESGPGTSESATPESGPGTSESATPESGPGSEPATSGSETPGSEPATSGSETPGSPA GSPTSTEEGTSTEPSEGSAPGTSTEPSEGSAPGSEPATS | 102 |
| AE360A | PESGPGTSTEPSEGSAPGTSESATPESGPGSPAGSPTSTEEGSPAGSPTSTEEGSPA GSPTSTEEGTSESATPESGPGTSTEPSEGSAPGTSESATPESGPGSEPATSGSETPG TSESATPESGPGSEPATSGSETPGTSESATPESGPGTSTEPSEGSAPGSPAGSPTST EEGTSESATPESGPGSEPATSGSETPGTSESATPESGPGSPAGSPTSTEEGSPAGSP TSTEEGTSTEPSEGSAPGTSESATPESGPGTSESATPESGPGTSESATPESGPGSEP ATSGSETPGSEPATSGSETPGSPAGSPTSTEEGTSTEPSEGSAPGTSTEPSEGSAPG SEPATSGSETPGTSESAT | 103 |
| AE396A | PESGPGSEPATSGSETPGTSESATPESGPGTSTEPSEGSAPGTSESATPESGPGSPA GSPTSTEEGSPAGSPTSTEEGSPAGSPTSTEEGTSESATPESGPGTSTEPSEGSAPG TSESATPESGPGSEPATSGSETPGTSESATPESGPGSEPATSGSETPGTSESATPES GPGTSTEPSEGSAPGSPAGSPTSTEEGTSESATPESGPGSEPATSGSETPGTSESAT PESGPGSPAGSPTSTEEGSPAGSPTSTEEGTSTEPSEGSAPGTSESATPESGPGTSE SATPESGPGTSESATPESGPGSEPATSGSETPGSEPATSGSETPGSPAGSPTSTEEG TSTEPSEGSAPGTSTEPS | 104 |
| AE432A | EGSAPGSPAGSPTSTEEGTSTEPSEGSAPGTSESATPESGPGSEPATSGSETPGTSE SATPESGPGSEPATSGSETPGTSESATPESGPGTSTEPSEGSAPGTSESATPESGPG SPAGSPTSTEEGSPAGSPTSTEEGSPAGSPTSTEEGTSESATPESGPGTSTEPSEGS APGTSESATPESGPGSEPATSGSETPGTSESATPESGPGSEPATSGSETPGTSESAT PESGPGTSTEPSEGSAPGSPAGSPTSTEEGTSESATPESGPGSEPATSGSETPGTSE SATPESGPGSPAGSPTSTEEGSPAGSPTSTEEGTSTEPSEGSAPGTSESATPESGPG TSESATPESGPGTSESATPESGPGSEPATSGSETPGSEPATSGSETPGSPAGSPTST EEGTSTEPSEGSAPGTSTEPSEGSAPGSEPATS | 105 |
| AE468A | EGSAPGTSTEPSEGSAPGTSTEPSEGSAPGSPAGSPTSTEEGTSTEPSEGSAPGTSE SATPESGPGSEPATSGSETPGTSESATPESGPGSEPATSGSETPGTSESATPESGPG TSTEPSEGSAPGTSESATPESGPGSPAGSPTSTEEGSPAGSPTSTEEGSPAGSPTST EEGTSESATPESGPGTSTEPSEGSAPGTSESATPESGPGSEPATSGSETPGTSESAT PESGPGSEPATSGSETPGTSESATPESGPGTSTEPSEGSAPGSPAGSPTSTEEGTSE SATPESGPGSEPATSGSETPGTSESATPESGPGSPAGSPTSTEEGSPAGSPTSTEEG TSTEPSEGSAPGTSESATPESGPGTSESATPESGPGTSESATPESGPGSEPATSGSE TPGSEPATSGSETPGSPAGSPTSTEEGTSTEPSEGSAPGTSTEPSEGSAPGSEPATS GSETPGTSESAT | 106 |
| AE504A | EGSAPGTSTEPSEGSAPGTSTEPSEGSAPGTSTEPSEGSAPGTSTEPSEGSAPGSPA GSPTSTEEGTSTEPSEGSAPGTSESATPESGPGSEPATSGSETPGTSESATPESGPG SEPATSGSETPGTSESATPESGPGTSTEPSEGSAPGTSESATPESGPGSPAGSPTST EEGSPAGSPTSTEEGSPAGSPTSTEEGTSESATPESGPGTSTEPSEGSAPGTSESAT PESGPGSEPATSGSETPGTSESATPESGPGSEPATSGSETPGTSESATPESGPGTST EPSEGSAPGSPAGSPTSTEEGTSESATPESGPGSEPATSGSETPGTSESATPESGPG SPAGSPTSTEEGSPAGSPTSTEEGTSTEPSEGSAPGTSESATPESGPGTSESATPES GPGTSESATPESGPGSEPATSGSETPGSEPATSGSETPGSPAGSPTSTEEGTSTEPS EGSAPGTSTEPSEGSAPGSEPATSGSETPGTSESATPESGPGTSTEPS | 107 |
| AE540A | TPESGPGSPAGSPTSTEEGTSESATPESGPGSEPATSGSETPGTSESATPESGPGTS TEPSEGSAPGTSTEPSEGSAPGTSTEPSEGSAPGTSTEPSEGSAPGTSTEPSEGSAP GTSTEPSEGSAPGSPAGSPTSTEEGTSTEPSEGSAPGTSESATPESGPGSEPATSGS ETPGTSESATPESGPGSEPATSGSETPGTSESATPESGPGTSTEPSEGSAPGTSESA | 108 |

TABLE 4-continued

XTEN Polypeptides

| XTEN Name | Amino Acid Sequence | SEQ ID NO: |
|---|---|---|
| | TPESGPGSPAGSPTSTEEGSPAGSPTSTEEGSPAGSPTSTEEGTSESATPESGPGTS TEPSEGSAPGTSESATPESGPGSEPATSGSETPGTSESATPESGPGSEPATSGSETP GTSESATPESGPGTSTEPSEGSAPGSPAGSPTSTEEGTSESATPESGPGSEPATSGS ETPGTSESATPESGPGSPAGSPTSTEEGSPAGSPTSTEEGTSTEPSEGSAPGTSESA TPESGPGTSESATPESGPGTSESATPESGPGSEPATSGSETPGSEPATSGSETPGSP AGSPTSTEEGTSTEPSEGSAPGTSTEP | |
| AE576A | TPESGPGTSESATPESGPGSPAGSPTSTEEGTSESATPESGPGSEPATSGSETPGTS ESATPESGPGTSTEPSEGSAPGTSTEPSEGSAPGTSTEPSEGSAPGTSTEPSEGSAP GTSTEPSEGSAPGTSTEPSEGSAPGSPAGSPTSTEEGTSTEPSEGSAPGTSESATPE SGPGSEPATSGSETPGTSESATPESGPGSEPATSGSETPGTSESATPESGPGTSTEP SEGSAPGTSESATPESGPGSPAGSPTSTEEGSPAGSPTSTEEGSPAGSPTSTEEGTS ESATPESGPGTSTEPSEGSAPGTSESATPESGPGSEPATSGSETPGTSESATPESGP GSEPATSGSETPGTSESATPESGPGTSTEPSEGSAPGSPAGSPTSTEEGTSESATPE SGPGSEPATSGSETPGTSESATPESGPGSPAGSPTSTEEGSPAGSPTSTEEGTSTEP SEGSAPGTSESATPESGPGTSESATPESGPGSEPATSGSETPGSE PATSGSETPGSPAGSPTSTEEGTSTEPSEGSAPGTSTEPSEGSAPGSEPATSGSETP GTSESA | 109 |
| AE612A | GSETPGTSTEPSEGSAPGTSTEPSEGSAPGTSESATPESGPGTSESATPESGPGSPA GSPTSTEEGTSESATPESGPGSEPATSGSETPGTSESATPESGPGTSTEPSEGSAPG TSTEPSEGSAPGTSTEPSEGSAPGTSTEPSEGSAPGTSTEPSEGSAPGTSTEPSEGS APGSPAGSPTSTEEGTSTEPSEGSAPGTSESATPESGPGSEPATSGSETPGTSESAT PESGPGSEPATSGSETPGTSESATPESGPGTSTEPSEGSAPGTSESATPESGPGSPA GSPTSTEEGSPAGSPTSTEEGSPAGSPTSTEEGTSESATPESGPGTSTEPSEGSAPG TSESATPESGPGSEPATSGSETPGTSESATPESGPGSEPATSGSETPGTSESATPES GPGTSTEPSEGSAPGSPAGSPTSTEEGTSESATPESGPGSEPATSGSETPGTSESAT PESGPGSPAGSPTSTEEGSPAGSPTSTEEGTSTEPSEGSAPGTSESATPESGPGTSE SATPESGPGTSESATPESGPGSEPATSGSETPGSEPATSGSETPGSPAGSPTSTEEG TSTEPSEGSAPGTSTEPSEGSAPGSEPATSGSETPGTSESAT | 110 |
| AE648A | PESGPGTSTEPSEGSAPGTSESATPESGPGSEPATSGSETPGTSTEPSEGSAPGTST EPSEGSAPGTSESATPESGPGTSESATPESGPGSPAGSPTSTEEGTSESATPESGPG SEPATSGSETPGTSESATPESGPGTSTEPSEGSAPGTSTEPSEGSAPGTSTEPSEGS APGTSTEPSEGSAPGTSTEPSEGSAPGTSTEPSEGSAPGSPAGSPTSTEEGTSTEPS EGSAPGTSESATPESGPGSEPATSGSETPGTSESATPESGPGSEPATSGSETPGTSE SATPESGPGTSTEPSEGSAPGTSESATPESGPGSPAGSPTSTEEGSPAGSPTSTEEG SPAGSPTSTEEGTSESATPESGPGTSTEPSEGSAPGTSESATPESGPGSEPATSGSE TPGTSESATPESGPGSEPATSGSETPGTSESATPESGPGTSTEPSEGSAPGSPAGSP TSTEEGTSESATPESGPGSEPATSGSETPGTSESATPESGPGSPAGSPTSTEEGSPA GSPTSTEEGTSTEPSEGSAPGTSESATPESGPGTSESATPESGPGTSESATPESGPG SEPATSGSETPGSEPATSGSETPGSPAGSPTSTEEGTSTEPSEGSAPGTSTEPSEGS APGSEPATSGSETPGTSESAT | 111 |
| AE684A | EGSAPGSPAGSPTSTEEGTSTEPSEGSAPGTSTEPSEGSAPGTSESATPESGPGTST EPSEGSAPGTSESATPESGPGSEPATSGSETPGTSTEPSEGSAPGTSTEPSEGSAPG TSESATPESGPGTSESATPESGPGSPAGSPTSTEEGSATPESGPGSEPATSGSE TPGTSESATPESGPGTSTEPSEGSAPGTSTEPSEGSAPGTSTEPSEGSAPGTSTEPS EGSAPGTSTEPSEGSAPGTSTEPSEGSAPGSPAGSPTSTEEGTSTEPSEGSAPGTSE SATPESGPGSEPATSGSETPGTSESATPESGPGSEPATSGSETPGTSESATPESGPG TSTEPSEGSAPGTSESATPESGPGSPAGSPTSTEEGSPAGSPTSTEEGSPAGSPTST EEGTSESATPESGPGTSTEPSEGSAPGTSESATPESGPGSEPATSGSETPGTSESAT PESGPGSEPATSGSETPGTSESATPESGPGTSTEPSEGSAPGSPAGSPTSTEEGTSE SATPESGPGSEPATSGSETPGTSESATPESGPGSPAGSPTSTEEGSPAGSPTSTEEG TSTEPSEGSAPGTSESATPESGPGTSESATPESGPGTSESATPESGPGSEPATSGSE TPGSEPATSGSETPGSPAGSPTSTEEGTSTEPSEGSAPGTSTEPSEGSAPGSEPATS | 112 |
| AE720A | TSGSETPGSEPATSGSETPGSPAGSPTSTEEGTSESATPESGPGTSTEPSEGSAPGT STEPSEGSAPGSPAGSPTSTEEGTSTEPSEGSAPGTSTEPSEGSAPGTSESATPESG PGTSTEPSEGSAPGTSESATPESGPGSEPATSGSETPGTSTEPSEGSAPGTSTEPSE GSAPGTSESATPESGPGTSESATPESGPGSPAGSPTSTEEGTSESATPESGPGSEPA TSGSETPGTSESATPESGPGTSTEPSEGSAPGTSTEPSEGSAPGTSTEPSEGSAPGT STEPSEGSAPGTSTEPSEGSAPGTSTEPSEGSAPGSPAGSPTSTEEGTSTEPSEGSA PGTSESATPESGPGSEPATSGSETPGTSESATPESGPGSEPATSGSETPGTSESATP ESGPGTSTEPSEGSAPGTSESATPESGPGSPAGSPTSTEEGSPAGSPTSTEEGSPAG SPTSTEEGTSESATPESGPGTSTEPSEGSAPGTSESATPESGPGSEPATSGSETPGT SESATPESGPGSEPATSGSETPGTSESATPESGPGTSTEPSEGSAPGSPAGSPTSTE EGTSESATPESGPGSEPATSGSETPGTSESATPESGPGSPAGSPTSTEEGSPAGSPT STEEGTSTEPSEGSAPGTSESATPESGPGTSESATPESGPGTSESATPESGPGSEPA TSGSETPGSEPATSGSETPGSPAGSPTSTEEGTSTE | 113 |
| AE756A | TSGSETPGSEPATSGSETPGSPAGSPTSTEEGTSESATPESGPGTSTEPSEGSAPGT STEPSEGSAPGSPAGSPTSTEEGTSTEPSEGSAPGTSTEPSEGSAPGTSESATPESG PGTSTEPSEGSAPGTSESATPESGPGSEPATSGSETPGTSTEPSEGSAPGTSTEPSE GSAPGTSESATPESGPGTSESATPESGPGSPAGSPTSTEEGTSESATPESGPGSEPA | 114 |

TABLE 4-continued

XTEN Polypeptides

| XTEN Name | Amino Acid Sequence | SEQ ID NO: |
|---|---|---|
| | TSGSETPGTSESATPESGPGTSTEPSEGSAPGTSTEPSEGSAPGT STEPSEGSAPGTSTEPSEGSAPGTSTEPSEGSAPGSPAGSPTSTEEGTSTEPSEGSA PGTSESATPESGPGSEPATSGSETPGTSESATPESGPGSEPATSGSETPGTSESATP ESGPGTSTEPSEGSAPGTSESATPESGPGSPAGSPTSTEEGSPAGSPTSTEEGSPAG SPTSTEEGTSESATPESGPGTSTEPSEGSAPGTSESATPESGPGSEPATSGSETPGT SESATPESGPGSEPATSGSETPGTSESATPESGPGTSTEPSEGSAPGSPAGSPTSTE EGTSESATPESGPGSEPATSGSETPGTSESATPESGPGSPAGSPTSTEEGSPAGSPT STEEGTSTEPSEGSAPGTSESATPESGPGTSESATPESGPGSEPA TSGSETPGSEPATSGSETPGSPAGSPTSTEEGTSTEPSEGSAPGTSTEPSEGSAPGS EPATSGSETPGTSES | |
| AE792A | EGSAPGTSESATPESGPGSEPATSGSETPGSEPATSGSETPGSPAGSPTSTEEGTSE SATPESGPGTSTEPSEGSAPGTSTEPSEGSAPGSPAGSPTSTEEGTSTEPSEGSAPG TSTEPSEGSAPGTSESATPESGPGTSTEPSEGSAPGTSESATPESGPGSEPATSGSE TPGTSTEPSEGSAPGTSTEPSEGSAPGTSESATPESGPGTSESATPESGPGSPAGSP TSTEEGTSESATPESGPGSEPATSGSETPGTSESATPESGPGTSTEPSEGSAPGTST EPSEGSAPGTSTEPSEGSAPGTSTEPSEGSAPGTSTEPSEGSAPGTSTEPSEGSAPG SPAGSPTSTEEGTSTEPSEGSAPGTSESATPESGPGSEPATSGSETPGTSESATPES GPGSEPATSGSETPGTSESATPESGPGTSTEPSEGSAPGTSESATPESGPGSPAGSP TSTEEGSPAGSPTSTEEGSPAGSPTSTEEGTSESATPESGPGTSTEPSEGSAPGTSE SATPESGPGSEPATSGSETPGTSESATPESGPGSEPATSGSETPGTSESATPESGPG TSTEPSEGSAPGSPAGSPTSTEEGTSESATPESGPGSEPATSGSETPGTSESATPES GPGSPAGSPTSTEEGSPAGSPTSTEEGTSTEPSEGSAPGTSESATPESGPGTSESAT PESGPGTSESATPESGPGSEPATSGSETPGSEPATSGSETPGSPAGSPTSTEEGTST EPSEGSAPGTSTEPSEGSAPGSEPATSGSETPGTSESATPESGPGTSTEPS | 115 |
| AE828A | PESGPGTSTEPSEGSAPGSPAGSPTSTEEGTSTEPSEGSAPGTSTEPSEGSAPGTSE SATPESGPGSEPATSGSETPGSEPATSGSETPGSPAGSPTSTEEGTSESATPESGPG TSTEPSEGSAPGTSTEPSEGSAPGSPAGSPTSTEEGTSTEPSEGSAPGTSTEPSEGS APGTSESATPESGPGTSTEPSEGSAPGTSESATPESGPGSEPATSGSETPGTSTEPS EGSAPGTSTEPSEGSAPGTSESATPESGPGTSESATPESGPGSPAGSPTSTEEGTSE SATPESGPGSEPATSGSETPGTSESATPESGPGTSTEPSEGSAPGTSTEPSEGSAPG TSTEPSEGSAPGTSTEPSEGSAPGTSTEPSEGSAPGTSTEPSEGSAPGSPAGSPTST EEGTSTEPSEGSAPGTSESATPESGPGSEPATSGSETPGTSESATPESGPGSEPATS GSETPGTSESATPESGPGTSTEPSEGSAPGTSESATPESGPGSPAGSPTSTEEGSPA GSPTSTEEGSPAGSPTSTEEGTSESATPESGPGTSTEPSEGSAPGTSESATPESGPG SEPATSGSETPGTSESATPESGPGSEPATSGSETPGTSTEPSEGS APGSPAGSPTSTEEGTSESATPESGPGSEPATSGSETPGTSESATPESGPGSPAGSP TSTEEGSPAGSPTSTEEGTSTEPSEGSAPGTSESATPESGPGTSESATPESGPGTSE SATPESGPGSEPATSGSETPGSEPATSGSETPGSPAGSPTSTEEGTSTEPSEGSAPG TSTEPSEGSAPGSEPATSGSETPGTSESAT | 116 |
| AG72A | GPGSSPSASTGTGPGTPGSGTASSSPGSSTPSGATGSPGSSPSASTGTGPGASPGT SSTGSPGTPGSGTASS | 117 |
| AG72B | GSSTPSGATGSPGSSTPSGATGSPGSSPSASTGTGPGSSPSASTGTGPGASPGTSS TGSPGTPGSGTASSSP | 118 |
| AG72C | SPSASTGTGPGASPGTSSTGSPGSSPSASTGTGPGTPGSGTASSSPGSSTPSGATG SPGSSTPSGATGSPGA | 119 |
| AG108A | SASTGTGPGSSPSASTGTGPGTPGSGTASSSPGSSTPSGATGSPGSSPSASTGTGP GASPGTSSTGSPGTPGSGTASSSPGASP | 120 |
| AG108B | PGTPGSGTASSSPGSSTPSGATGSPGTPGSGTASSSPGSSTPSGATGSPGSSTPSG ATGSPGSSPSASTGTGPGSSPSASTGTGPGASPGTSSTGSPGTPGSGTASSS | 121 |
| AG144A | PGSSPSASTGTGPGSSPSASTGTGPGTPGSGTASSSPGSSTPSGATGSPGSSPSAST GTGPGASPGTSSTGSPGTPGSGTASSSPGSSTPSGATGSPGTPGSGTASSSPGASP GTSSTGSPGASPGTSSTGSPGTPGSGTASSS | 122 |
| AG144B | PSGATGSPGTPGSGTASSSPGSSTPSGATGSPGSSTPSGATGSPGSSPSASTGTGP GSSPSASTGTGPGASPGTSSTGSPGTPGSGTASSSPGSSTPSGATGSPGSSPSAST GTGPGSSPSASTGTGPGASPGTSSTGSPGASP | 123 |
| AG180A | TSSTGSPGSSPSASTGTGPGSSPSASTGTGPGTPGSGTASSSPGSSTPSGATGSPGS SPSASTGTGPGASPGTSSTGSPGTPGSGTASSSPGSSTPSGATGSPGTPGSGTASS SPGASPGTSSTGSPGASPGTSSTGSPGTPGSGTASSSPGSSTPSGATGSPGASPGT SSTGSPGTPGS | 124 |
| AG216A | TGTGPGSSPSASTGTGPGTPGSGTASSSPGSSTPSGATGSPGSSPSASTGTGPGAS PGTSSTGSPGTPGSGTASSSPGSSTPSGATGSPGTPGSGTASSSPGASPGTSSTGSP GASPGTSSTGSPGTPGSGTASSSPGSSTPSGATGSPGASPGTSSTGSPGTPGSGTA SSSPGSSTPSGATGSPGSSPSASTGTGPGSSPSASTGTGPGSSTPSG | 125 |

TABLE 4-continued

XTEN Polypeptides

| XTEN Name | Amino Acid Sequence | SEQ ID NO: |
|---|---|---|
| AG252A | TSSTGSPGSSPSASTGTGPGSSPSASTGTGPGTPGSGTASSSPGSSTPSGATGSPGS SPSASTGTGPGASPGTSSTGSPGTPGSGTASSSPGSSTPSGATGSPGTPGSGTASS SPGASPGTSSTGSPGASPGTSSTGSPGTPGSGTASSSPGSSTPSGATGSPGASPGT SSTGSPGTPGSGTASSSPGSSTPSGATGSPGSSPSASTGTGPGSSPSASTGTGPGSS TPSGATGSPGSSTPSGATGSPGASPG | 126 |
| AG288A | TSSTGSPGSSPSASTGTGPGSSPSASTGTGPGTPGSGTASSSPGSSTPSGATGSPGS SPSASTGTGPGASPGTSSTGSPGTPGSGTASSSPGSSTPSGATGSPGTPGSGTASS SPGASPGTSSTGSPGASPGTSSTGSPGTPGSGTASSSPGSSTPSGATGSPGASPGT SSTGSPGTPGSGTASSSPGSSTPSGATGSPGSSPSASTGTGPGSSPSASTGTGPGSS TPSGATGSPGSSTPSGATGSPGASPGTSSTGSPGASPGTSSTGSPGASPGTSSTGS PGTPGS | 127 |
| AG324A | TSSTGSPGTPGSGTASSSPGASPGTSSTGSPGASPGTSSTGSPGASPGTSSTGSPG ASPGTSSTGSPGTPGSGTASSSPGSSTPSGATGSPGTPGSGTASSSPGSSTPSGAT GSPGTPGSGTASSSPGSSTPSGATGSPGSSTPSGATGSPGSSPSASTGTGPGSSPSA STGTGPGASPGTSSTGSPGTPGSGTASSSPGSSTPSGATGSPGSSPSASTGTGPGS SPSASTGTGPGASPGTSSTGSPGASPGTSSTGSPGSSTPSGATGSPGSSPSASTGT GPGASPGTSSTGSPGSSPSASTGTGPGTPGSGTASSSPGSSTP | 128 |
| AG360A | TSSTGSPGASPGTSSTGSPGTPGSGTASSSPGASPGTSSTGSPGASPGTSSTGSPG ASPGTSSTGSPGASPGTSSTGSPGTPGSGTASSSPGSSTPSGATGSPGTPGSGTAS SSPGSSTPSGATGSPGTPGSGTASSSPGSSTPSGATGSPGSSTPSGATGSPGSSPSA STGTGPGSSPSASTGTGPGASPGTSSTGSPGTPGSGTASSSPGSSTPSGATGSPGS SPSASTGTGPGSSPSASTGTGPGASPGTSSTGSPGASPGTSSTGSPGSSTPSGATG SPGSSPSASTGTGPGASPGTSSTGSPGSSPSASTGTGPGTPGSGTASSSPGSSTPSG ATGSPGSSTPSGATGSPGASPG | 129 |
| AG396A | GATGSPGSSTPSGATGSPGSSPSASTGTGPGASPGTSSTGSPGASPGTSSTGSPGT PGSGTASSSPGASPGTSSTGSPGASPGTSSTGSPGASPGTSSTGSPGASPGTSSTG SPGTPGSGTASSSPGSSTPSGATGSPGTPGSGTASSSPGSSTPSGATGSPGTPGSG TASSSPGSSTPSGATGSPGSSTPSGATGSPGSSPSASTGTGPGSSPSASTGTGPGA SPGTSSTGSPGTPGSGTASSSPGSSTPSGATGSPGSSPSASTGTGPGSSPSASTGTG PGASPGTSSTGSPGASPGTSSTGSPGSSTPSGATGSPGSSPSASTGTGPGASPGTS STGSPGSSPSASTGTGPGTPGSGTASSSPGSSTPSGATGSPGSSTPSGATGSPGAS PGT | 130 |
| AG432A | GATGSPGSSTPSGATGSPGASPGTSSTGSPGTPGSGTASSSPGSSTPSGATGSPGS STPSGATGSPGSSTPSGATGSPGSSPSASTGTGPGASPGTSSTGSPGASPGTSSTG SPGTPGSGTASSSPGASPGTSSTGSPGASPGTSSTGSPGASPGTSSTGSPGASPGT SSTGSPGTPGSGTASSSPGSSTPSGATGSPGTPGSGTASSSPGSSTPSGATGSPGTP GSGTASSSPGSSTPSGATGSPGSSTPSGATGSPGSSPSASTGTGPGSSPSASTGTG PGASPGTSSTGSPGTPGSGTASSSPGSSTPSGATGSPGSSPSASTGTGPGSSPSAST GTGPGASPGTSSTGSPGASPGTSSTGSPGSSTPSGATGSPGSSPSASTGTGPGASP GTSSTGSPGSSPSASTGTGPGTPGSGTASSSPGSSTPS | 131 |
| AG468A | TSSTGSPGSSPSASTGTGPGTPGSGTASSSPGASPGTSSTGSPGASPGTSSTGSPG ASPGTSSTGSPGSSTPSGATGSPGSSTPSGATGSPGASPGTSSTGSPGTPGSGTAS SSPGSSTPSGATGSPGSSTPSGATGSPGSSTPSGATGSPGSSPSASTGTGPGASPG TSSTGSPGASPGTSSTGSPGTPGSGTASSSPGASPGTSSTGSPGASPGTSSTGSPG ASPGTSSTGSPGASPGTSSTGSPGTPGSGTASSSPGASPGTSSTGSPGASPGTSSTGSPG SSPGSSTPSGATGSPGTPGSGTASSSPGSSTPSGATGSPGSSPSA STGTGPGSSPSASTGTGPGASPGTSSTGSPGTPGSGTASSSPGSSTPSGATGSPGS SPSASTGTGPGSSPSASTGTGPGASPGTSSTGSPGASPGTSSTGSPGSSTPSGATG SPGSSPSASTGTGPGASPG | 132 |
| AG504A | TSSTGSPGSSPSASTGTGPGTPGSGTASSSPGASPGTSSTGSPGASPGTSSTGSPG ASPGTSSTGSPGSSTPSGATGSPGSSTPSGATGSPGASPGTSSTGSPGTPGSGTAS SSPGSSTPSGATGSPGSSTPSGATGSPGSSTPSGATGSPGSSPSASTGTGPGASPG TSSTGSPGASPGTSSTGSPGTPGSGTASSSPGASPGTSSTGSPGASPGTSSTGSPG ASPGTSSTGSPGASPGTSSTGSPGTPGSGTASSSPGASPGTPGSGTPGSGTAS SSPGSSTPSGATGSPGTPGSGTASSSPGSSTPSGATGSPGSSPSA STGTGPGSSPSASTGTGPGASPGTSSTGSPGTPGSGTASSSPGSSTPSGATGSPGS SPSASTGTGPGSSPSASTGTGPGASPGTSSTGSPGASPGTSSTGSPGSSTPSGATG SPGSSPSASTGTGPGASPGTSSTGSPGSSPSASTGTGPGTPGSGTASSSPGSSTP | 133 |
| AG540A | TSSTGSPGASPGTSSTGSPGSSPSASTGTGPGTPGSGTASSSPGASPGTSSTGSPG ASPGTSSTGSPGASPGTSSTGSPGSSTPSGATGSPGSSTPSGATGSPGASPGTSST GSPGTPGSGTASSSPGSSTPSGATGSPGSSTPSGATGSPGSSPSA STGTGPGASPGTSSTGSPGASPGTSSTGSPGTPGSGTASSSPGASPGTSSTGSPGA SPGTSSTGSPGASPGTSSTGSPGASPGTSSTGSPGTPGSGTASSSPGSSTPSGATGS PGTPGSGTASSSPGSSTPSGATGSPGTPGSGTASSSPGSSTPSGATGSPGSSTPSG ATGSPGSSPSASTGTGPGSSPSASTGTGPGASPGTSSTGSPGTPGSGTASSSPGSS TPSGATGSPGSSPSASTGTGPGSSPSASTGTGPGASPGTSSTGSPGASPGTSSTGS | 134 |

TABLE 4-continued

XTEN Polypeptides

| XTEN Name | Amino Acid Sequence | SEQ ID NO: |
|---|---|---|
| | PGSSTPSGATGSPGSSPSASTGTGPGASPGTSSTGSPGSSPSASTGTGPGTPGSGT ASSSPGSSTPSGATGSPGSSTPSGATGSPGASPG | |
| AG576A | TSSTGSPGTPGSGTASSSPGASPGTSSTGSPGASPGTSSTGSPGASPGTSSTGSPGS SPSASTGTGPGTPGSGTASSSPGASPGTSSTGSPGASPGTSSTGSPGASPGTSSTG SPGSSTPSGATGSPGSSTPSGATGSPGASPGTSSTGSPGPTGSGTASSSPGSSTPSG ATGSPGSSTPSGATGSPGSSTPSGATGSPGSSPSASTGTGPGASPGTSSTGSPGAS PGTSSTGSPGPTGSGTASSSPGASPGTSSTGSPGASPGTSSTGSPGASPGTSSTGSP GASPGTSSTGSPGTPGSGTASSSPGSSTPSGATGSPGTPGSGTASSSPGSSTPSGA TGSPGTPGSGTASSSPGSSTPSGATGSPGSSTPSGATGSPGSSPSASTGTGPGSSPS ASTGTGPGASPGTSSTGSPGTPGSGTASSSPGSSTPSGATGSPGSSPSASTGTGPG SSPSASTGTGPGASPGTSSTGSPGASPGTSSTGSPGSSTPSGATGSPGSSPSASTGT GPGASPGTSSTGSPGSSPSASTGTGPGTPGSGTASSSPGSSTPSGATGSPGSSTPS GATGSPGASPG | 135 |
| AG612A | STGSPGTPGSGTASSSPGSSTPSGATGSPGASPGTSSTGSPGPTGSGTASSSPGSST PSGATGSPGSSPSASTGTGPGSSPSASTGTGPGSSTPSGATGSPGSSTPSGATGSP GASPGTSSTGSPGASPGTSSTGSPGASPGTSSTGSPGPTGSGTASSSPGASPGTSS TGSPGASPGTSSTGSPGASPGTSSTGSPGSSPSASTGTGPGPTGSGTASSSPGASP GTSSTGSPGASPGTSSTGSPGASPGTSSTGSPGSSPSASTGTGPGSSTPSGATGSP GASPGTSSTGSPGTPGSGTASSSPGSSTPSGATGSPGSSTPSGATGSPGSSTPSGA TGSPGSSPSASTGTGPGASPGTSSTGSPGASPGTSSTGSPGTPGSGTASSSPGASP GTSSTGSPGASPGTSSTGSPGASPGTSSTGSPGASPGTSSTGSPGPTGSGTASSSP GSSTPSGATGSPGTPGSGTASSSPGSSTPSGATGSPGTPGSGTPSSSPGSSTPSGA TGSPGSSTPSGATGSPGSSPSASTGTGPGSSPSASTGTGPGASPGTSSTGSPGTPG SGTASSSPGSSTPSGATGSPGSSPSASTGTGPGSSPSASTGTGPGASPGTS | 136 |
| AG648A | GTASSSPGSSTPSGATGSPGSSPSASTGTGPGSSPSASTGTGPGSSTPSGATGSPG SSTPSGATGSPGASPGTSSTGSPGASPGTSSTGSPGASPGTSSTGSPGTPGSGTAS SSPGASPGTSSTGSPGASPGTSSTGSPGASPGTSSTGSPGSSPSASTGTGPGTPGS GTASSSPGASPGTSSTGSPGASPGTSSTGSPGASPGTSSTGSPGSSTPSGATGSPG SSTPSGATGSPGASPGTSSTGSPGPTGSGTASSSPGSSTPSGATGSPGSSTPSGAT GSPGSSTPSGATGSPGSSPSASTGTGPGASPGTSSTGSPGASPGTSSTGSPGPTGS GTASSSPGASPGTSSTGSPGASPGTSSTGSPGASPGTSSTGSPGASPGTSSTGSPG TPGSGTASSSPGSSTPSGATGSPGTPGSGTASSSPGSSTPSGATGSPGTPGSGTAS SSPGSSTPSGATGSPGSSTPSGATGSPGSSPSASTGTGPGSSPSASTGTGPGASPG TSSTGSPGTPGSGTASSSPGSSTPSGATGSPGSSPSASTGTGPGSSPSASTGTGPG ASPGTSSTGSPGASPGTSSTGSPGSSTPSGATGSPGSSPSASTGTGPGASPGTSST GSPGSSPSASTGTGPGTPGSGTASSSPGSSTP | 137 |
| AG684A | TSSTGSPGTPGSGTASSSPGSSTPSGATGSPGSSPSASTGTGPGSSPSASTGTGPGS STPSGATGSPGSSTPSGATGSPGASPGTSSTGSPGASPGTSSTGSPGASPGTSSTG SPGTPGSGTASSSPGASPGTSSTGSPGASPGTSSTGSPGASPGTSSTGSPGSSPSAS TGTGPGTPGSGTASSSPGASPGTSSTGSPGASPGTSSTGSPGASPGTSSTGSPGSS TPSGATGSPGSSTPSGATGSPGASPGTSSTGSPGPTGSGTASSSPGSSTPSGATGS PGSSTPSGATGSPGSSTPSGATGSPGSSPSASTGTGPGASPGTSSTGSPGASPGTS STGSPGTPGSGTASSSPGASPGTSSTGSPGASPGTSSTGSPGASPGTSSTGSPGAS PGTSSTGSPGTPGSGTASSSPGSSTPSGATGSPGTPGSGTASSSPGSSTPSGATGSP GTPGSGTASSSPGSSTPSGATGSPGSSTPSGATGSPGSSPSASTGTGPGSSPSAST GTGPGASPGTSSTGSPGTPGSGTASSSPGSSTPSGATGSPGSSPSASTGTGPGSSP SASTGTGPGASPGTSSTGSPGASPGTSSTGSPGSSTPSGATGSPGSSPSASTGTGP GASPGTSSTGSPGSSPSASTGTGPGTPGSGTASSSPGSSTPSGATGSPGSSTPSGA TGSPGASPG | 138 |
| AG720A | TSSTGSPGTPGSGTASSSPGSSTPSGATGSPGASPGTSSTGSPGTPGSGTASSSPGS STPSGATGSPGSSPSASTGTGPGSSPSASTGTGPGSSTPSGATGSPGSSTPSGATG SPGASPGTSSTGSPGASPGTSSTGSPGASPGTSSTGSPGTPGSGTASSSPGASPGT SSTGSPGASPGTSSTGSPGASPGTSSTGSPGSSPSASTGTGPGTPGSGTASSSPGA SPGTSSTGSPGASPGTSSTGSPGASPGTSSTGSPGSSTPSGATGSPGSSTPSGATGS PGASPGTSSTGSPGTPGSGTASSSPGSSTPSGATGSPGSSTPSGATGSPGSSTPSG ATGSPGSSPSASTGTGPGASPGTSSTGSPGASPGTSSTGSPGTPGSGTASSSPGAS PGTSSTGSPGASPGTSSTGSPGASPGTSSTGSPGTPGSGTASSSP GSSTPSGATGSPGTPGSGTASSSPGSSTPSGATGSPGTPGSGTASSSPGSSTPSGA TGSPGSSTPSGATGSPGSSPSASTGTGPGSSPSASTGTGPGASPGTSSTGSPGTPG SGTASSSPGSSTPSGATGSPGSSPSASTGTGPGSSPSASTGTGPGASPGTSSTGSP GASPGTSSTGSPGSSTPSGATGSPGSSPSASTGTGPGASPGTSSTGSPGSSPSAST GTGPGTPGSGTASSSPGSSTPSGATGSPGSSTPSGATGSPGASPG | 139 |
| AG756A | TSSTGSPGSSPSASTGTGPGSSPSASTGTGPGTPGSGTASSSPGSSTPSGATGSPGS SPSASTGTGPGASPGTSSTGSPGTPGSGTASSSPGSSTPSGATGSPGTPGSGTASS SPGASPGTSSTGSPGASPGTSSTGSPGTPGSGTASSSPGSSTPSGATGSPGASPGT SSTGSPGTPGSGTASSSPGSSTPSGATGSPGSSPSASTGTGPGSSPSASTGTGPGSS TPSGATGSPGSSTPSGATGSPGASPGTSSTGSPGASPGTSSTGSPGASPGTSSTGS PGTPGSGTASSSPGASPGTSSTGSPGASPGTSSTGSPGASPGTSSTGSPGSSPSAST GTGPGTPGSGTASSSPGASPGTSSTGSPGASPGTSSTGSPGASPGTSSTGSPGSST | 140 |

TABLE 4-continued

XTEN Polypeptides

| XTEN Name | Amino Acid Sequence | SEQ ID NO: |
|---|---|---|
| | PSGATGSPGSSTPSGATGSPGASPGTSSTGSPGTPGSGTASSSPGSSTPSGATGSP<br>GSSTPSGATGSPGSSTPSGATGSPGSSPSASTGTGPGASPGTSSTGSPGASPGTSS<br>TGSPGTPGSGTASSSPGASPGTSSTGSPGASPGTSSTGSPGASPGTSSTGSPGASP<br>GTSSTGSPGTPGSGTASSSPGSSTPSGATGSPGTPGSGTASSSPGSSTPSGATGSP<br>GTPGSGTASSSPGSSTPSGATGSPGSSTPSGATGSPGSSPSASTGTGPGSSPSAST<br>GTGPGASPGTSSTGSPGTPGSGTASSSPGSSTPSGATGSPGSSPSASTGTGPGSSP<br>SASTGTGPGASPGTSSTGSPGASPG | |
| AG792A | TSSTGSPGSSPSASTGTGPGSSPSASTGTGPGTPGSGTASSSPGSSTPSGATGSPGS<br>SPSASTGTGPGASPGTSSTGSPGTPGSGTASSSPGSSTPSGATGSPGTPGSGTASS<br>SPGASPGTSSTGSPGASPGTSSTGSPGTPGSGTASSSPGSSTPSGATGSPGASPGT<br>SSTGSPGTPGSGTASSSPGSSTPSGATGSPGSSPSASTGTGPGSSPSASTGTGPGSS<br>TPSGATGSPGSSTPSGATGSPGASPGTSSTGSPGASPGTSSTGSPGASPGTSSTGS<br>PGTPGSGTASSSPGASPGTSSTGSPGASPGTSSTGSPGASPGTSSTGSPGSSPSAST<br>GTGPGTPGSGTASSSPGASPGTSSTGSPGASPGTSSTGSPGASPGTSSTGSPGSST<br>PSGATGSPGSSTPSGATGSPGASPGTSSTGSPGTPGSGTASSSPGSSTPSGATGSP<br>GSSTPSGATGSPGSSTPSGATGSPGSSPSASTGTGPGASPGTSSTGSPGASPGTSS<br>TGSPGTPGSGTASSSPGASPGTSSTGSPGASPGTSSTGSPGASPGTSSTGSPGASP<br>GTSSTGSPGTPGSGTASSSPGSSTPSGATGSPGTPGSGTASSSPGSSTPSGATGSP<br>GTPGSGTASSSPGSSTPSGATGSPGSSTPSGATGSPGSSPSASTGTGPGSSPSAST<br>GTGPGASPGTSSTGSPGTPGSGTASSSPGSSTPSGATGSPGSSPSASTGTGPGSSP<br>SASTGTGPGASPGTSSTGSPGASPGTSSTGSPGSSTPSGATGSPGSSPSASTGTGP<br>GASPG | 141 |
| AG828A | TSSTGSPGSSPSASTGTGPGSSPSASTGTGPGTPGSGTASSSPGSSTPSGATGSPGS<br>SPSASTGTGPGASPGTSSTGSPGTPGSGTASSSPGSSTPSGATGSPGTPGSGTASS<br>SPGASPGTSSTGSPGASPGTSSTGSPGTPGSGTASSSPGSSTPSGATGSPGASPGT<br>SSTGSPGTPGSGTASSSPGSSTPSGATGSPGSSPSASTGTGPGSSPSASTGTGPGSS<br>TPSGATGSPGSSTPSGATGSPGASPGTSSTGSPGASPGTSSTGSPGASPGTSSTGS<br>PGTPGSGTASSSPGASPGTSSTGSPGASPGTSSTGSPGASPGTSSTGSPGSSPSAST<br>GTGPGTPGSGTASSSPGASPGTSSTGSPGASPGTSSTGSPGASPGTSSTGSPGSST<br>PSGATGSPGSSTPSGATGSPGASPGTSSTGSPGTPGSGTASSSPGSSTPSGATGSP<br>GSSTPSGATGSPGSSTPSGATGSPGSSPSASTGTGPGASPGTSSTGSPGASPGTSS<br>TGSPGTPGSGTASSSPGASPGTSSTGSPGASPGTSSTGSPGASPGTSSTGSPGASP<br>GTSSTGSPGTPGSGTASSSPGSSTPSGATGSPGTPGSGTASSSPGSSTPSGATGSP<br>GTPGSGTASSSPGSSTPSGATGSPGSSTPSGATGSPGSSPSASTGTGPGSSPSAST<br>GTGPGASPGTSSTGSPGTPGSGTASSSPGSSTPSGATGSPGSSPSASTGTGPGSSP<br>SASTGTGPGASPGTSSTGSPGASPGTSSTGSPGSSTPSGATGSPGSSPSASTGTGP<br>GASPGTSSTGSPGSSPSASTGTGPGTPGSGTASSSPGSSTP | 142 |

In other embodiments, the binding fusion protein composition comprises one or more non-repetitive XTEN sequences of about 36 to about 3000 amino acid residues, wherein at least about 80%, or at least about 90%, or about 91%, or about 92%, or about 93%, or about 94%, or about 95%, or about 96%, or about 97%, or about 98%, or about 99% to about 100% of the sequence consists of non-overlapping 36 amino acid sequence motifs selected from one or more of the polypeptide sequences of Tables 11-14, either as a family sequence, or where motifs are selected from two or more families of motifs.

In those embodiments wherein the XTEN component of the fusion protein has less than 100% of its amino acids consisting of four to six amino acid selected from glycine (G), alanine (A), serine (S), threonine (T), glutamate (E) and proline (P), or less than 100% of the sequence consisting of the sequences from any one of Tables 4 or 11-14, the other amino acid residues are selected from any other of the 14 natural L-amino acids, but are preferentially selected from hydrophilic amino acids such that the XTEN sequence contains at least about 90%, or at least about 91%, or at least about 92%, or at least about 93%, or at least about 94%, or at least about 95%, or at least about 96%, or at least about 97%, or at least about 98%, or at least about 99% hydrophilic amino acids. The XTEN amino acids that are not glycine (G), alanine (A), serine (S), threonine (T), glutamate (E) and proline (P) are interspersed throughout the XTEN sequence, are located within or between the sequence motifs, or are concentrated in one or more short stretches of the XTEN sequence. In such cases where the XTEN component of the binding fusion protein comprises amino acids other than glycine (G), alanine (A), serine (S), threonine (T), glutamate (E) and proline (P), it is preferred that the amino acids not be hydrophobic residues and should not substantially confer secondary structure of the XTEN component. Hydrophobic residues that are less favored in construction of XTEN include tryptophan, phenylalanine, tyrosine, leucine, isoleucine, valine, and methionine. Additionally, one can design the XTEN sequences to contain less than 5% or less than 4% or less than 3% or less than 2% or less than 1% or none of the following amino acids: cysteine (to avoid disulfide formation and oxidation), methionine (to avoid oxidation), asparagine and glutamine (to avoid desamidation). Thus, in some embodiments, the XTEN component of the fusion protein comprising other amino acids in addition to glycine (G), alanine (A), serine (S), threonine (T), glutamate (E) and proline (P) would have a sequence with less than 5% of the residues contributing to alpha-helices and beta-sheets as measured by the Chou-Fasman algorithm and have at least 90%, or at least about 95% or more random coil formation as measured by the GOR algorithm.

3. Length of Sequence

In another aspect, the invention provides binding fusion protein compositions comprising an binding protein and one or more XTEN polypeptides wherein the length of the XTEN sequences are chosen based on the property or function to be achieved. Depending on the intended property or function, the binding fusion protein compositions comprise short or intermediate length XTEN and/or longer XTEN sequences that can serve as carriers. The subject binding fusion proteins encompass XTEN or fragments of XTEN with lengths of about 6, or about 12, or about 36, or about 40, or about 100, or about 144, or about 288, or about 401, or about 500, or about 600, or about 700, or about 800, or about 900, or about 1000, or about 1500, or about 2000, or about 2500, or up to about 3000 amino acid residues in length. In other cases, the XTEN sequences can be about 6 to about 50, or about 100 to about 150, about 150 to 250, about 250 to 400, about 400 to about 500, about 500 to 900, about 900 to 1500, about 1500 to 2000, or about 2000 to about 3000 amino acid residues in length. In the embodiments of the binding fusion proteins, the one or more XTEN or fragments of XTEN sequences individually exhibit at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity compared to a motif or an XTEN selected from any one of Tables 4 or 11-14, or a fragment thereof with comparable length. In some embodiments, the bind fusion proteins comprise a first and at least a second XTEN sequence, wherein the cumulative length of the residues in the XTEN sequences is greater than about 100 to about 3000 amino acid residues and the XTEN can be identical or they can be different in sequence or in length. As used herein, "cumulative length" is intended to encompass the total length, in amino acid residues, when more than one XTEN is incorporated into the binding fusion proteins of the embodiments. In one embodiment of the foregoing, the first and at least the second sequences each exhibit at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity compared to one or more XTEN sequences from Table 4, or fragments thereof.

As described more fully below, methods are disclosed in which the binding fusion protein is designed by selecting the length of the XTEN to confer a target half-life or other physicochemical property on a fusion protein administered to a subject. When XTEN are used as a carrier, the invention takes advantage of the discovery that increasing the length of the non-repetitive, unstructured polypeptides enhances the unstructured nature of the XTENs and correspondingly enhances the biological and pharmacokinetic properties of fusion proteins comprising the XTEN carrier. As described more fully in the Examples, proportional increases in the length of the XTEN, even if created by a repeated order of single family sequence motifs (e.g., the four AE motifs of Table 3), result in a sequence with a higher percentage of random coil formation, as determined by GOR algorithm, or reduced content of alpha-helices or beta-sheets, as determined by Chou-Fasman algorithm, compared to shorter XTEN lengths. In addition, increasing the length of the unstructured polypeptide fusion partner, as described in the Examples, results in a fusion protein with a disproportionate increase in terminal half-life compared to fusion proteins with unstructured polypeptide partners with shorter sequence lengths. In general, XTEN cumulative lengths longer that about 400 residues incorporated into the binding fusion protein compositions result in longer half-life compared to shorter cumulative lengths; e.g., shorter than about 280 residues.

In some embodiments, where the XTEN serve primarily as a carrier, the invention encompasses binding fusion protein compositions comprising one or more XTEN wherein the cumulative XTEN sequence length of the fusion protein(s) is greater than about 100, or greater than about 200, or greater than about 400, or greater than about 500, or greater than about 600, or greater than about 800, or greater than about 900, or greater than about 1000 to about 3000 amino acid residues, wherein the fusion protein exhibits enhanced pharmacokinetic properties when administered to a subject compared to a binding protein not linked to XTEN and administered at a comparable dose. In one embodiment of the foregoing, the one or more XTEN sequences exhibit at least about 80%, or at least about 90%, or at least about 91%, or at least about 92%, or at least about 93%, or at least about 94%, or at least about 95%, or at least about 96%, or at least about 97%, or at least about 98% or more identity to a sequence selected from Table 4, or fragments thereof, and the remainder of the carrier sequence(s) contain at least 90% hydrophilic amino acids and less than about 2% of the overall sequence consists of hydrophobic or aromatic amino acids or cysteine. The enhanced pharmacokinetic properties of the binding fusion proteins in comparison to binding proteins not linked to XTEN are described more fully, below.

4. XTEN Segments

In one aspect, the invention provides XTEN of short or intermediate lengths, wherein the choice of the XTEN confers different functions or properties to the binding fusion proteins. In particular binding fusion protein configuration designs, where the XTEN serve as a flexible linker, or are designed to interfere with clearance receptors, or where a short or intermediate length of XTEN is used to facilitate tissue penetration or to vary the strength of interactions of the binding fusion protein with its target, or where it is desirable to distribute the cumulative length of XTEN in at least two segments of short or intermediate length, the invention provides binding fusion proteins comprising one or more truncated XTEN sequences.

The XTEN of short or intermediate lengths can be an XTEN or a fragment of an XTEN of a length of from about 6 amino acids to about 600 amino acids, or about 12 to about 288 amino acids, or about 36 to about 144 amino acids, or about 42 to about 96 amino acids in length. Non-limiting examples of short or intermediate length XTEN contemplated for inclusion in the binding fusion proteins embodiments of the disclosure are presented in Table 4, but can also include fragments of the motifs of Table 3 or fragments of the sequences of Table 4 used singly or linked in combination using the methods disclosed herein to achieve an XTEN of a given length, including lengths encompassed by the ranges disclosed above. In non-limiting examples, as schematically depicted in FIGS. 39A-C, the AG864 sequence of 864 amino acid residues can be truncated to yield an AG144 with 144 residues, an AG288 with 288 residues, an AG576 with 576 residues, or other intermediate lengths, while the AE864 sequence (FIGS. 39D-E) can be truncated to yield an AE288 or AE576 or other intermediate lengths. It is specifically contemplated that such an approach can be utilized with any of the XTEN embodiments described herein or with any of the sequences listed in Table 4 to result in XTEN of a desired length.

In another aspect, the invention provides XTEN of longer lengths wherein the sequence is substantially non-repetitive. The incorporation of longer length XTEN as carriers into binding fusion proteins confers enhanced properties on the fusion proteins compared to fusion partners of shorter length XTEN, including slower rates of systemic absorption, increased bioavailability, and increased half-life after subcutaneous or intramuscular administration to a subject, and longer terminal half-life or area under the curve. In one embodiment, the XTEN of longer lengths have greater than about 400, or greater than about 600, or greater than about 800, or greater than about 900, or greater than about 1000, or greater than about 1100, or greater than about 1200, or greater than about 1300, or greater than about 1400, or greater than about 1500, or greater than about 1600, or greater than about 1700, or greater than about 1800, or greater than about 1900, or greater than about 2000, up to about 3000 amino acid residues or more in length, wherein the assembled XTEN is substantially non-repetitive.

In some embodiments, the binding fusion proteins comprise at least two XTEN segments in which the XTEN segments can be identical or they can be different wherein the cumulative length of the XTEN components are greater than about 100 to about 3000 amino acid residues and comprises at least one sequence segment of at least about 36 to about 923, or at least about 42 to about 875, or at least about 96 to about 576, or at least about 100 to about 288, or at least about 132 to about 144 amino acid residues wherein the sequence segment(s) consists of at least four, or at least five, or at least six different types of amino acids and the sum of glycine (G), alanine (A), serine (S), threonine (T), glutamate (E) and proline (P) residues in the sequence segment(s) constitutes at least about 80%, or at least about 85%, or at least about 90%, or at least about 91%, or at least about 92%, or at least about 93%, or at least about 94%, or at least about 95%, or at least about 96%, or at least about 97%, or at least about 98%, or at least about 99% of the total amino acid sequence of the sequence segment and at least about 90%, or at least about 91%, or at least about 92%, or at least about 93%, or at least about 94%, or at least about 95%, or at least about 96%, or at least about 97%, or at least about 98% of the remainder of the XTEN sequence(s) consist of hydrophilic amino acids and less than about 2% of the remainder of the XTEN sequence(s) consists of hydrophobic or aromatic amino acids, or cysteine. In another embodiment, the invention provides an isolated binding fusion protein wherein the cumulative length of the XTEN component is greater than about 100 to about 3000 amino acid residues and comprises at least one sequence segment of at least about 36 to about 923, or at least about 42 to about 875, or at least about 96 to about 576, or at least about 100 to about 288, or at least about 132 to about 144 amino acid residues wherein the sequence segment(s) the sum of glycine (G), alanine (A), serine (S), threonine (T), glutamate (E) and proline (P) residues in the sequence segment(s) constitutes at least about 90%, or at least about 91%, or at least about 92%, or at least about 93%, or at least about 94%, or at least about 95%, or at least about 96%, or at least about 97%, or at least about 98%, or at least about 99% of the total amino acid sequence of the sequence segment and wherein the subsequence score of a segment or the cumulative segments is less than 10, or less than 9, or less than 8, or less than 7, or less than 6, or less than 5, and at least about 90%, or at least about 91%, or at least about 92%, or at least about 93%, or at least about 94%, or at least about 95%, or at least about 96%, or at least about 97%, or at least about 98% of the remainder of the XTEN sequence(s) consist of hydrophilic amino acids and less than about 2% of the remainder of the XTEN sequence(s) consists of hydrophobic, aromatic or cysteine amino acids.

5. N-Terminal XTEN Expression-Enhancing Sequences

In one embodiment, the invention provides a short-length XTEN sequence designed to be incorporated as the N-terminal portion of the binding fusion protein, wherein the expression of the fusion protein is enhanced in a host cell transformed with a suitable expression vector comprising an optimized N-terminal leader sequence (that encodes the N-terminal XTEN) incorporated into the polynucleotide encoding the binding fusion protein. It has been discovered, as described in Examples 14-17, that a host cell transformed with such an expression vector comprising an optimized N-terminal leader sequence (NTS) in the binding fusion protein gene results in greatly-enhanced expression of the binding fusion protein compared to the expression of a corresponding binding fusion protein from a polynucleotide not comprising the NTS, and can obviate the need for incorporation of a non-XTEN leader sequence used to enhance expression. In one embodiment of the foregoing, the invention provides binding fusion proteins comprising an NTS wherein the expression of the binding fusion protein from the encoding gene in a host cell is enhanced about 50%, or about 75%, or about 100%, or about 150%, or about 200%, or about 400% compared to expression of a binding fusion protein not comprising the N-terminal XTEN sequence (where the encoding gene lacks the NTS).

In one embodiment of the foregoing, the N-terminal XTEN polypeptide comprises a sequence that exhibits at least about 80%, more preferably at least about 90%, more preferably at least about 91%, more preferably at least about 92%, more preferably at least about 93%, more preferably at least about 94%, more preferably at least about 95%, more preferably at least about 96%, more preferably at least about 97%, more preferably at least about 98%, more preferably at least about 99%, or exhibits 100% sequence identity to the amino acid sequence of AE48 or AM48, the respective sequences as follows:

AE48:
(SEQ ID NO: 143)
MAEPAGSPTSTEEGTPGSGTASSSPGSSTPSGATGSPGASPGTSSTGS

AM48:
(SEQ ID NO: 144)
MAEPAGSPTSTEEGASPGTSSTGSPGSSTPSGATGSPGSSTPSGATGS

In another embodiment, the short-length N-terminal XTEN can be linked to an XTEN of longer length to form the N-terminal region of the binding fusion protein, wherein the polynucleotide sequence encoding the short-length N-terminal XTEN confers the property of enhanced expression in the host cell, and wherein the long length of the expressed XTEN contributes to the enhanced properties of the XTEN carrier in the fusion protein, as described above. In the foregoing, the short-length XTEN can be linked to any of the XTEN disclosed herein (e.g., an XTEN of Table 4) and the resulting XTEN can, in turn, be linked to the N-terminal of any of the targeting moieties disclosed herein (e.g., a targeting moiety directed to a target of Table 1) as a component of the binding fusion protein. Alternatively, polynucleotides encoding the short-length XTEN (or its complement) can be linked to polynucleotides encoding any of the XTEN (or its complement) disclosed herein and the resulting gene encoding the N-terminal XTEN can, in turn, be linked to the 5' end of polynucleotides encoding any of the targeting moieties (or to the 3' end of its complement) disclosed herein. In preferred embodiments of the foregoing, the N-terminal XTEN polypeptide with long length can exhibit at least about 80%, or at least about 90%, or at least about 91%, or at least about 92%, or at least about 93%, or at least about 94%, or at least about 95%, or at least about 96%, or at least about 97%, or at least about 98%, or at least 99%, or exhibits 100% sequence identity to an amino acid sequence selected from the group consisting of the sequences AE624, AE912, and AM923.

In any of the foregoing N-terminal XTEN embodiments described above, the N-terminal XTEN can have from about one to about six additional amino acid residues, preferably selected from glycine, serine, threonine, glutamate, proline and alanine, to accommodate the endonuclease restriction sites that is employed to join the nucleotides encoding the N-terminal XTEN to the gene encoding the targeting moiety of the fusion protein. Non-limiting examples of amino acids compatible with the restrictions sites and the preferred amino acids are listed in Table 6, below. The methods for the generation of the N-terminal sequences and incorporation into the fusion proteins of the invention are described more fully in the Examples.

6. Net Charge

In other embodiments, the XTEN polypeptides have an unstructured characteristic imparted by incorporation of amino acid residues with a net charge and containing a low proportion or no hydrophobic amino acids in the XTEN sequence. The overall net charge and net charge density is controlled by modifying the content of charged amino acids in the XTEN sequences, either positive or negative, with the net charge typically represented as the percentage of amino acids in the polypeptide contributing to a charged state beyond those residues that are cancelled by a residue with an opposing charge. In some embodiments, the net charge density of the XTEN of the compositions may be above +0.1 or below −0.1 charges/residue. By "net charge density" of a protein or peptide herein is meant the net charge divided by the total number of amino acids in the protein or propeptide. In other embodiments, the net charge of an XTEN can be about 0%, about 1%, about 2%, about 3%, about 4%, about 5%, about 6%, about 7%, about 8%, about 9%, about 10% about 11%, about 12%, about 13%, about 14%, about 15%, about 16%, about 17%, about 18%, about 19%, or about 20% or more. In some embodiments, the XTEN sequence comprises charged residues separated by other residues such as serine or glycine, which leads to better expression or purification behavior. Based on the net charge, some XTENs have an isoelectric point (pI) of 1.0, 1.5, 2.0, 2.5, 3.0, 3.5, 4.0, 4.5, 5.0, 5.5, 6.0, or even 6.5. In one embodiment, the XTEN will have an isoelectric point between 1.5 and 4.5 and carry a net negative charge under physiologic conditions.

Since most tissues and surfaces in a human or animal have a net negative charge, in some embodiments, the XTEN sequences are designed to have a net negative charge to minimize non-specific interactions between the XTEN containing compositions and various surfaces such as blood vessels, healthy tissues, or various receptors. Not to be bound by a particular theory, the XTEN can adopt open conformations due to electrostatic repulsion between individual amino acids of the XTEN polypeptide that individually carry a net negative charge and that are distributed across the sequence of the XTEN polypeptide. Such a distribution of net negative charge in the extended sequence lengths of XTEN can lead to an unstructured conformation that, in turn, can result in an effective increase in hydrodynamic radius. In preferred embodiments, the negative charge of the subject XTEN is conferred by incorporation of glutamic acid residues. For example, where an XTEN with a negative charge is desired, the XTEN can be selected solely from an AE family sequence, which has approximately a 17% net charge due to incorporated glutamic acid, or can include varying proportions of glutamic acid-containing motifs of Table 3 to provide the desired degree of net charge. Non-limiting examples of AE XTEN include, but are not limited to the AE36, AE42, AE48, AE144, AE288, AE576, AE624, AE864, and AE912 polypeptide sequences of Tables 4 or 12, or fragments thereof. In one embodiment, an XTEN sequence of Tables 4 or 11-15 can be modified to include additional glutamic acid residues to achieve the desired net negative charge. Accordingly, in one embodiment the invention provides XTEN in which the XTEN sequences contain about 1%, 2%, 4%, 8%, 10%, 15%, 17%, 20%, 25%, or even about 30% glutamic acid. Generally, the glutamic residues are spaced uniformly across the XTEN sequence. In some cases, the XTEN can contain about 10-80, or about 15-60, or about 20-50 glutamic residues per 20 kDa of XTEN that can result in an XTEN with charged residues that would have very similar pKa, which can increase the charge homogeneity of the product and sharpen its isoelectric point, enhance the physicochemical properties of the resulting binding fusion protein for, and hence, simplifying purification procedures. In one embodiment, the invention contemplates incorporation of aspartic acid residues into XTEN in addition to glutamic acid in order to achieve a net negative charge.

In other cases, where no net charge is desired, the XTEN can be selected from, for example, AG XTEN components, such as the AG motifs of Table 3, or those AM motifs of Table 3 that have approximately no net charge. Non-limiting examples of AG XTEN include, but are not limited to AG42, AG144, AG288, AG576, and AG864 polypeptide sequences of Tables 4 or 14, or fragments thereof. In another embodiment, the XTEN can comprise varying proportions of AE and AG motifs in order to have a net charge that is deemed optimal for a given use or to maintain a given physicochemical property.

Not to be bound by a particular theory, the XTEN of the binding fusion protein compositions with the higher net charge are expected to have less non-specific interactions with various negatively-charged surfaces such as blood vessels, tissues, or various receptors, which would further contribute to reduced active clearance. Conversely, it is believed that the XTEN of the binding fusion protein compositions with a low or no net charge would have a higher degree of interaction with surfaces that can potentiate the activity of the associated binding protein, given the known contribution of phagocytic cells in the inflammatory process in the lung.

The XTEN of the compositions of the present invention generally have no or a low content of positively charged amino acids. In some embodiments, the XTEN may have less than about 10% amino acid residues with a positive charge, or less than about 7%, or less than about 5%, or less than about 2%, or less than about 1% amino acid residues with a positive charge. However, the invention contemplates constructs where a limited number of amino acids with a positive charge, such as lysine, are incorporated into XTEN to permit conjugation between the epsilon amine of the lysine and a reactive group on a peptide, a linker bridge, or a reactive group on a drug or small molecule to be conjugated to the XTEN backbone. In one embodiment of the foregoing, the XTEN has between about 1 to about 100 lysine residues, or about 1 to about 70 lysine residues, or about 1 to about 50 lysine residues, or about 1 to about 30 lysine residues, or about 1 to about 20 lysine residues, or about 1 to about 10 lysine residues, or about 1 to about 5 lysine residues, or alternatively only a single lysine residue. Using the foregoing lysine-containing XTEN, fusion proteins are constructed that comprises XTEN, a binding protein, plus a chemotherapeutic agent useful in the treatment of diseases or disorders, wherein the maximum number of molecules of the agent incorporated into the XTEN component is determined by the numbers of lysines or other amino acids with reactive side chains (e.g., cysteine) incorporated into the XTEN.

As hydrophobic amino acids impart structure to a polypeptide, the invention provides that the content of hydrophobic amino acids in the XTEN will typically be less than 5%, or less than 2%, or less than 1% hydrophobic amino acid content. In one embodiment, the amino acid content of methionine and tryptophan in the XTEN component of a binding fusion protein is typically less than 5%, or less than 2%, and most preferably less than 1%. In another embodiment, the XTEN will have a sequence that has less than 10% amino acid residues with a positive charge, or less than about 7%, or less that about 5%, or less than about 2% amino acid residues with a positive charge, the sum of methionine and tryptophan residues will be less than 2%, and the sum of asparagine and glutamine residues will be less than 10% of the total XTEN sequence.

7. Low Immunogenicity

In another aspect, the invention provides compositions in which the XTEN sequences have a low degree of immunogenicity or are substantially non-immunogenic. Several factors can contribute to the low immunogenicity of XTEN, e.g., the non-repetitive sequence, the unstructured conformation, the high degree of solubility, the low degree or lack of self-aggregation, the low degree or lack of proteolytic sites within the sequence, and the low degree or lack of epitopes in the XTEN sequence.

Conformational epitopes are formed by regions of the protein surface that are composed of multiple discontinuous amino acid sequences of the protein antigen. The precise folding of the protein brings these sequences into a well-defined, stable spatial configurations, or epitopes, that can be recognized as "foreign" by the host humoral immune system, resulting in the production of antibodies to the protein or triggering a cell-mediated immune response. In the latter case, the immune response to a protein in an individual is heavily influenced by T-cell epitope recognition that is a function of the peptide binding specificity of that individual's HLA-DR allotype. Engagement of a MHC Class II peptide complex by a cognate T-cell receptor on the surface of the T-cell, together with the cross-binding of certain other co-receptors such as the CD4 molecule, can induce an activated state within the T-cell. Activation leads to the release of cytokines further activating other lymphocytes such as B cells to produce antibodies or activating T killer cells as a full cellular immune response.

The ability of a peptide to bind a given MHC Class II molecule for presentation on the surface of an APC (antigen presenting cell) is dependent on a number of factors; most notably its primary sequence. In one embodiment, a lower degree of immunogenicity may be achieved by designing XTEN sequences that resist antigen processing in antigen presenting cells, and/or choosing sequences that do not bind MHC receptors well. The invention provides binding fusion proteins with substantially non-repetitive XTEN polypeptides designed to reduce binding with MHC II receptors, as well as avoiding formation of epitopes for T-cell receptor or antibody binding, resulting in a low degree of immunogenicity. Avoidance of immunogenicity is, in part, a direct result of the conformational flexibility of XTEN sequences; i.e., the lack of secondary structure due to the selection and order of amino acid residues. For example, of particular interest are sequences having a low tendency to adapt compactly folded conformations in aqueous solution or under physiologic conditions that could result in conformational epitopes. The administration of fusion proteins comprising XTEN, using conventional therapeutic practices and dosing, would generally not result in the formation of neutralizing antibodies to the XTEN sequence, and may also reduce the immunogenicity of the targeting moiety fusion partner in the binding fusion protein compositions.

In one embodiment, the XTEN sequences utilized in the subject fusion proteins can be substantially free of epitopes recognized by human T cells. The elimination of such epitopes for the purpose of generating less immunogenic proteins has been disclosed previously; see for example WO 98/52976, WO 02/079232, and WO 00/3317 which are incorporated by reference herein. Assays for human T cell epitopes have been described (Stickler, M., et al. (2003) *J Immunol Methods*, 281: 95-108). Of particular interest are peptide sequences that can be oligomerized without generating T cell epitopes or non-human sequences. This can be achieved by testing direct repeats of these sequences for the presence of T-cell epitopes and for the occurrence of 6 to 15-mer and, in particular, 9-mer sequences that are not human, and then altering the design of the XTEN sequence to eliminate or disrupt the epitope sequence. In one embodiment, the XTEN sequences are substantially non-immunogenic by the restriction of the numbers of epitopes of the XTEN predicted to bind MHC receptors. With a reduction in the numbers of epitopes capable of binding to MHC receptors, there is a concomitant reduction in the potential for T cell activation as well as T cell helper function, reduced B cell activation or upregulation and reduced antibody production. The low degree of predicted T-cell epitopes can be determined by epitope prediction algorithms such as, e.g., TEPITOPE (Sturniolo, T., et al. (1999) Nat Biotechnol, 17: 555-61), as shown in Example 59. The TEPITOPE score of a given peptide frame within a protein is the log of the $K_d$ (dissociation constant, affinity, off-rate) of the binding of that peptide frame to multiple of the most common human MHC alleles, as disclosed in Sturniolo, T. et al. (1999) *Nature Biotechnology* 17:555). The score ranges over at least 20 logs, from about 10 to about –10 (corresponding to binding constraints of $10e^{10}$ $K_d$ to $10e^{-10}$ $K_d$), and can be reduced by avoiding hydrophobic amino acids that can serve as anchor residues during peptide display on MHC, such as M, I, L, V, F. In some embodiments, an XTEN component incorporated into a binding fusion protein does not have a predicted T-cell epitope at a TEPITOPE threshold score of about –5, or –6, or –7, or –8, or –9, or at a TEPITOPE score of –10. As used herein, a score of "–9" would be a more stringent TEPITOPE threshold than a score of –5.

In another embodiment, the inventive XTEN sequences, including those incorporated into the subject binding fusion proteins, can be rendered substantially non-immunogenic by the restriction of known proteolytic sites from the sequence of the XTEN, reducing the processing of XTEN into small peptides that can bind to MHC II receptors. In another embodiment, the XTEN sequence can be rendered substantially non-immunogenic by the use a sequence that is substantially devoid of secondary structure, conferring resistance to many proteases due to the high entropy of the structure. Accordingly, the reduced TEPITOPE score and elimination of known proteolytic sites from the XTEN may render the XTEN compositions, including the XTEN of the binding fusion protein compositions, substantially unable to be bound by mammalian receptors, including those of the immune system. In one embodiment, an XTEN of a binding fusion protein can have >100 nM $K_d$ binding to a mammalian receptor, or greater than 500 nM $K_d$, or greater than 1 μM $K_d$ towards a mammalian cell surface or circulating polypeptide receptor.

Additionally, the non-repetitive sequence and corresponding lack of epitopes of XTEN can limit the ability of B cells to bind to or be activated by XTEN. A repetitive sequence is recognized and can form multivalent contacts with even a few B cells and, as a consequence of the cross-linking of multiple T-cell independent receptors, can stimulate B cell proliferation and antibody production. In contrast, while a XTEN can make contacts with many different B cells over its extended sequence, each individual B cell may only make one or a small number of contacts with an individual XTEN due to the lack of repetitiveness of the sequence. As a result, XTENs typically may have a much lower tendency to stimulate proliferation of B cells and thus an immune response. In one embodiment, the binding fusion protein may have reduced immunogenicity as compared to the corresponding targeting moiety that is not fused. In one embodiment, the administration of up to three parenteral doses of a binding fusion protein to a mammal may result in detectable anti-binding fusion protein IgG at a serum dilution of 1:100 but not at a dilution of 1:1000. In another embodiment, the administration of up to three parenteral doses of a binding fusion protein to a mammal may result in detectable anti-targeting moiety IgG at a serum dilution of 1:100 but not at a dilution of 1:1000. In another embodiment, the administration of up to three parenteral doses of a binding fusion protein to a mammal may result in detectable anti-XTEN IgG at a serum dilution of 1:100 but not at a dilution of 1:1000. In the foregoing embodiments, the mammal can be a mouse, a rat, a rabbit, or a cynomolgus monkey.

An additional feature of XTENs with non-repetitive sequences relative to sequences with a high degree of repetitiveness can be that non-repetitive XTENs form weaker contacts with antibodies. Antibodies are multivalent molecules. For instance, IgGs have two identical binding sites and IgMs contain 10 identical binding sites. Thus antibodies against repetitive sequences can form multivalent contacts with such repetitive sequences with high avidity, which can affect the potency and/or elimination of such repetitive sequences. In contrast, antibodies against non-repetitive XTENs may yield monovalent interactions, resulting in less likelihood of immune clearance such that the binding fusion protein compositions can remain in circulation for an increased period of time.

8. Increased Hydrodynamic Radius

In another aspect, the present invention provides XTEN in which the XTEN polypeptides can have a high hydrodynamic radius that confers a corresponding increased apparent molecular weight factor to fusion protein incorporating the XTEN. As detailed in Example 40, the linking of XTEN to targeting moiety sequences can result in binding fusion protein compositions that can have increased hydrodynamic radii, increased apparent molecular weight factor, and increased apparent molecular weight factor compared to a targeting moiety not linked to an XTEN. For example, in therapeutic applications in which prolonged half-life is desired, compositions in which a XTEN with a high hydrodynamic radius is incorporated into a fusion protein comprising one or more targeting moieties can effectively enlarge the hydrodynamic radius of the composition beyond the glomerular pore size of approximately 3-5 nm (corresponding to an apparent molecular weight of about 70 kDA) (Caliceti. 2003. Pharmacokinetic and biodistribution properties of poly (ethylene glycol)-protein conjugates. Adv Drug Deliv Rev 55:1261-1277), resulting in reduced renal clearance of circulating proteins. The hydrodynamic radius of a protein is determined by its molecular weight as well as by its structure, including shape and compactness. Not to be bound by a particular theory, the XTEN can adopt open conformations due to electrostatic repulsion between individual charges of the peptide or the inherent flexibility imparted by the particular amino acids in the sequence that lack potential to confer secondary structure. The open, extended and unstructured conformation of the XTEN polypeptide can have a greater proportional hydrodynamic radius compared to polypeptides of a comparable sequence length and/or molecular weight that have secondary and/or tertiary structure, such as typical globular proteins. Methods for determining the hydrodynamic radius are well known in the art, such as by the use of size exclusion chromatography (SEC), as described in U.S. Pat. Nos. 6,406,632 and 7,294,513. As the results of Example 40 demonstrate, the addition of increasing lengths of XTEN to a payload polypeptide results in proportional increases in the parameters of hydrodynamic radius, apparent molecular weight factor, and apparent molecular weight factor, permitting the tailoring of binding fusion proteins to desired characteristic cut-off apparent molecular weight factors or hydrodynamic radii. Accordingly, in certain embodiments, the binding fusion protein can be configured with an XTEN such that the fusion protein can have a hydrodynamic radius of at least about 5 nm, or at least about 8 nm, or at least about 10 nm, or 12 nm, or at least about 15 nm. In the foregoing embodiments, the large hydrodynamic radius conferred by the XTEN in a binding fusion protein can lead to reduced renal clearance of the resulting fusion protein, leading to a corresponding increase in terminal half-life, an increase in mean residence time, and/or a decrease in renal clearance rate.

In another embodiment, an XTEN of a chosen length and sequence can be selectively incorporated into a binding fusion protein to create a fusion protein that will have, under physiologic conditions, an apparent molecular weight of at least about 150 kDa, or at least about 300 kDa, or at least about 400 kDa, or at least about 500 kDA, or at least about 600 kDa, or at least about 700 kDA, or at least about 800 kDa, or at least about 900 kDa, or at least about 1000 kDa, or at least about 1200 kDa, or at least about 1500 kDa, or at least about 1800 kDa, or at least about 2000 kDa, or at least about 2300 kDa or more. In another embodiment, an XTEN of a chosen length and sequence can be selectively linked to a targeting moiety to result in a binding fusion protein that has, under physiologic conditions, an apparent molecular weight factor of at least three, alternatively of at least four, alternatively of at least five, alternatively of at least six, alternatively of at least eight, alternatively of at least 10, alternatively of at least 15, or an apparent molecular weight factor of at least 20 or greater. In another embodiment, the binding fusion protein has, under physiologic conditions, an apparent molecular weight factor that is about 4 to about 20, or is about 6 to about 15, or is about 8 to about 12, or is about 9 to about 10 relative to the actual molecular weight of the fusion protein.

(c) Targeting Moieties

In another aspect of the invention, targeting moieties are disclosed that can be linked to one or more XTEN, resulting in monomeric binding fusion protein compositions. "Targeting moieties", as used herein, refers to polypeptides that have specific binding affinity for a target ligand such as cytokines, chemokines, cytokine receptors, chemokines receptors, hormones, cell-surface receptors or antigens or glycoproteins, oligonucleotides, enzymatic substrates, antigenic determinants, or other binding sites that may be present in the circulation, or on the surface or in the cytoplasm of a target cell. Non-limiting, exemplary targets to which the targeting moieties of the subject compositions are directed are disclosed above; e.g., targets selected from Table 1 and Table 2. The invention provides multiple categories of targeting moieties that can be linked to one or more XTEN in various configurations, resulting in the inventive binding fusion protein compositions. As described more fully below, the targeting moieties can be derived from or based on sequences of antibodies, antibody fragments, receptors, immunoglobulin-like binding domains, or can be completely synthetic. The binding fusion proteins can comprise one or more functional antigen binding sites, the latter making the binding fusion protein "multivalent." An "antigen binding site" of a binding fusion protein is one that is capable of binding a target antigen with at least a portion of the binding affinity of the parental antibody or receptor from which the antigen binding site is derived. The antigen binding site may itself be composed of more than one binding domain, linked together in the binding fusion proteins. "Binding domain" means a polypeptide sequence capable of attaching to an antigen or ligand but that may require additional binding domains to actually bind and/or sequester the antigen or ligand. A CDR from an antibody is an example of a binding domain. "Antibody" is used throughout the specification as a prototypical example of a targeting moiety but is not intended to be limiting.

Methods to measure binding affinity and/or other biologic activity of the binding fusion protein compositions of the invention can be those disclosed herein or methods generally known in the art. In addition, the physicochemical properties of the binding fusion protein may be measured to ascertain the degree of solubility, structure and retention of stability. Assays are conducted that allow determination of binding characteristics of the targeting moieties towards a ligand, including binding dissociation constant ($K_d$, $K_{on}$ and $K_{off}$), the half-life of dissociation of the ligand-receptor complex, as well as the activity of the binding fusion protein to inhibit the biologic activity of the sequestered ligand compared to free ligand ($IC_{50}$ values). The term "$K_d$", as used herein, is intended to refer to the dissociation constant of a particular antibody-antigen interaction as is known in the art, and would apply as a parameter of the binding affinity of a targeting moiety to its cognate ligand for the subject compositions. The term "$K_{on}$", as used herein, is intended to refer to the on rate constant for association of an antibody to the antigen to form the antibody/antigen complex as is known in the art. The term "$K_{off}$", as used herein, is intended to refer to the off rate constant for dissociation of an antibody from the antibody/antigen complex as is known in the art. The term "$IC_{50}$" refers to the concentration needed to inhibit half of the maximum biological response of the ligand agonist, and is generally determined by competition binding assays.

Techniques such as flow cytometry or surface plasmon resonance can be used to detect binding events. The assays may comprise soluble antigens or receptor molecules, or may determine the binding to cell-expressed receptors. Such assays may include cell-based assays, including assays for proliferation, cell death, apoptosis and cell migration. The binding affinity of the subject compositions for the target ligands can be assayed using binding or competitive binding assays, such as Biacore assays with chip-bound receptors or binding proteins or ELISA assays, as described in U.S. Pat. No. 5,534,617, assays described in the Examples herein, radio-receptor assays, or other assays known in the art. The binding affinity constant can then be determined using standard methods, such as Scatchard analysis, as described by van Zoelen, et al., Trends Pharmacol Sciences (1998) 19)12):487, or other methods known in the art. In addition, libraries of sequence variants of targeting moieties can be compared to the corresponding native or parental antibodies using a competitive ELISA binding assay to determine whether they have the same binding specificity and affinity as the parental antibody, or some fraction thereof such that they are suitable for inclusion in the binding fusion proteins. The results of such assays can be used in an iterative process of sequence modification of the targeting moieties followed by binding and physicochemical characterization assays to guide the process by which specific constructs with the desired properties are selected.

In one embodiment, the invention provides isolated binding fusion proteins that competitively inhibit binding of an antibody to a target ligand, as determined by any method known in the art for determining competitive binding, such as the immunoassays described herein. The antibody can include the parental antibody from with the targeting moiety was derived or a positive control known to bind the target epitope or ligand. In preferred embodiments, the binding fusion protein competitively inhibits binding of the positive control to the ligand by at least 90%, at least 80%, at least 70%, at least 60%, or at least 50% in a competitive binding assay against the positive control.

The invention provides isolated binding fusion proteins in which the binding affinity of the one or more targeting moieties for target ligands can be at least about 1%, or at least about 10%, or at least about 20%, or at least about 30%, or at least about 40%, or at least about 50%, or at least about 60%, or at least about 70%, or at least about 80%, or at least about 90%, or at least about 95%, or at least about 99%, or at least about 99.9% or more of the affinity of a parental antibody not bound to XTEN for the target receptor or ligand. In one embodiment, the $K_d$ between the one or more targeting moieties of the subject binding fusion protein and a target ligand is less than about $10^{-4}$ M, alternatively less than about $10^{-5}$ M, alternatively less than about $10^{-6}$ M, alternatively less than about $10^{-7}$ M, alternatively less than about $10^{-8}$ M, alternatively less than about $10^{-9}$ M, or less than about $10^{-10}$ M, or less than about $10^{-11}$ M, or less than about $10^{-12}$ M. In the foregoing embodiment, the binding affinity of the binding fusion protein towards the target would be characterized as "specific." The invention contemplates binding fusion proteins comprising two or more targeting moieties in which the binding affinities for the respective targeting moieties may independently be between the ranges of values of the foregoing. In any of the foregoing embodiments of the paragraph, the one or more targeting moieties of the subject binding fusion proteins specifically bind to a target of Table 1 or Table 2.

Binding fusion proteins of the present invention may also be described or specified in terms of the cross-reactivity of the targeting moiety. In one embodiment, the invention provides binding fusion proteins that do not bind any other analog, ortholog, or homolog of a target disclosed herein. In one embodiment, binding fusion proteins can bind polypeptides with at least 95%, at least 90%, at least 85%, at least 80%, at least 75%, at least 70%, at least 65%, at least 60%, at least 55%, and at least 50% sequence identity (as calculated using methods known in the art and described herein) to a polypeptide target described herein.

The binding fusion proteins of the present invention may act as agonists or antagonists. For example, the present invention includes binding fusion proteins comprising targeting moieties that disrupt receptor/ligand interactions either partially or fully. The invention features both receptor-specific BFP and ligand-specific BFP. The invention also features receptor-specific binding fusion proteins that do not prevent ligand binding but prevent receptor activation. Receptor activation, such as cell signaling, may be determined by techniques described herein or otherwise known in the art. For example, receptor activation can be determined by detecting the phosphorylation (e.g., tyrosine or serine/threonine) of the receptor or its substrate by immunoprecipitation followed by standard Western blot analysis techniques. In specific embodiments, binding fusion proteins are provided that can bind to and inhibit ligand or receptor activity by at least 90%, at least 80%, at least 70%, at least 60%, or at least 50% of the activity compared to the activity in the absence of the binding fusion protein.

The invention provides receptor-specific binding fusion proteins that both prevent ligand binding and receptor activation as well as binding fusion proteins that recognize the receptor-ligand complex, yet, preferably, do not specifically recognize the unbound receptor or the unbound ligand. In one embodiment, the invention provides neutralizing binding fusion proteins that bind the ligand, thereby forming a neutralizing complex that prevents binding of the ligand to the receptor, or, in other cases, can bind the ligand but do not prevent the ligand from binding the receptor, yet nevertheless result in reduced receptor activation in comparison to non-complexed ligand. Further included in the invention are binding fusion proteins that activate the receptor. These BFP may act as receptor agonists, i.e., potentiate or activate either all or a subset of the biological activities of the ligand-mediated receptor activation.

In another embodiment, the invention provides isolated binding fusion proteins in which the fusion protein is designed to bind with high affinity to a target receptor, thereby resulting in antagonistic activity for the native ligand. In such cases, the BFPs can have affinity but no efficacy for their cognate receptors such that their binding will disrupt the interaction and inhibit the function of an agonist or inverse agonist at the receptors. Typically, such antagonistic activity will be of a competitive type, and a $K_i$ can be determined. A non-limiting example of an antagonist BFP is a fusion protein comprising a targeting moiety configured to bind to an IL-1 receptor (IL-1R) such that the bound composition substantially interferes with the binding of IL-1α and/or IL-1β to IL-1 receptor. In certain cases, the interference by an antagonist binding fusion protein (such as, but not limited to an anti-IL-1R binding fusion protein) with the binding of the native ligand to its cognate receptor can be at least about 1%, or about 10%, or about 20%, or about 30%, or about 40%, or about 50%, or about 60%, or about 70%, or about 80%, or about 90%, or about 95%, or about 99% or more. In other embodiments, the invention provides isolated binding fusion proteins (such as, but not limited to anti-IL-1R binding fusion protein) wherein the binding of the isolated fusion protein to a cellular receptor elicits less than 20%, or less than 10%, or less than 5% activation of the signaling pathways of the cell with bound binding fusion protein antagonist in comparison to those evoked by the native ligand.

In one embodiment, the invention provides isolated binding fusion proteins comprising targeting moieties directed to one or more target cytokines, cytokine-related proteins, cytokine receptors, chemokines, chemokines receptors, cell surface receptors, hormones or similar circulating proteins or peptides, oligonucleotides, or enzymatic substrates. In one embodiment, the one or more targeting moieties can have specific binding affinity to targets selected from, but not limited to the targets of Table 1. In another embodiment, the one or more targeting moieties can have specific binding affinity to targets selected from, but not limited to the tumor associated antigen targets of Table 2.

The present invention provides a variety of binding fusion protein configurations in which the variations are based on inclusion of the type and relative position or number of binding domains, as well as the inclusion of linkers of pre-determined length and one or more XTEN sequences. By design, the resulting binding fusion protein compositions can be monomeric or multivalent, they can bind a single ligand or antigen, or be multimeric as to the number of binding units encompassed in the fusion protein.

In one embodiment, the invention provides binding fusion proteins comprising targeting moieties capable of binding to a single ligand. In another embodiment, the binding fusion proteins of the invention are multivalent and the targeting moieties specifically bind at least two different target antigens or ligands ("bifunctional" or "bispecific"), or different epitopes on the same ligand. The multivalent binding fusion proteins can be designed to be bifunctional in that they can incorporate heterologous binding domains from different "parental" antibodies and bind two different ligands or antigens in order to better effect a desired pharmacological response; e.g., dimerization of receptors on a target cell surface leading to cell signaling or, alternatively, cell death, or modulating a biological function of one or more targets. Multimeric binding fusion protein leading to cell death, whether by triggering apoptosis or necrosis, are expected to have utility in, particularly, the treatment of oncological disease. Non-limiting examples of pairs of targets contemplated as suitable for multivalent, bifunctional binding fusion proteins include: IGF1 and IGF2; IGF1/2 and Erb2B; VEGFR and EGFR; CD20 and CD3, CD138 and CD20, CD38 and CD20, CD38 & CD138, CD40 and CD20, CD138 and CD40, CD38 and CD40.

In one embodiment, the binding fusion proteins of the invention specifically bind at least two cytokines, lymphokines, monokines, and/or polypeptide hormones. Non-limiting examples of pairs of targets to which bifunctional binding fusion proteins can bind are selected from, but not limited to IL-1α and IL-1β; IL-12 and IL-18, TNFα and IL-23, TNFα and IL-13; TNF and IL-18; TNF and IL-12; TNF and IL-1beta; TNF and MIF; TNF and IL-17; and TNF and IL-15; TNF and VEGF; VEGFR and EGFR; IL-13 and IL-9; IL-13 and IL-4; IL-13 and IL-5; IL-13 and IL-25; IL-13 and TARC; IL-13 and MDC; IL-13 and MIF; IL-13 and TGF-β; IL-13 and LHR agonist; IL-13 and CL25; IL-13 and SPRR2a; IL-13 and SPRR2b; IL-13 and ADAM8; and TNFα and PGE4, IL-13 and PED2, TNF and PEG2.

Examples of other pairs of targets suitable for multivalent bifunctional binding fusion proteins, include but are not limited to CD19 and CD20; CD-8 and IL-6; PDL-1 and CTLA-4; CTLA-4 and BTNO2; CSPGs and RGM A; IL-12 and IL-18; IL-12 and TWEAK; IL-13 and ADAM8; IL-13 and CL25; IL-13 and IL-1beta; IL-13 and IL-25; IL-13 and IL-4; IL-13 and IL-5; IL-13 and IL-9; IL-13 and LHR agonist; IL-13 and MDC; IL-13 and MIF; IL-13 and PED2; IL-13 and SPRR2a; IL-13 and SPRR2b; IL-13 and TARC; IL-13 and TGF-β; IL-1α and IL-1β; MAG and RGM A; NgR and RGM A; NogoA and RGM A; OMGp and RGM A; RGM A and RGM B; Te38 and TNFα; TNFα and IL-12; TNFα and IL-12p40; TNFα and IL-13; TNFα and IL-15; TNFα and IL-17; TNFα and IL-18; TNFα and IL-1beta; TNFα and IL-23; TNFα and MIF; TNFα and PEG2; TNFα and PGE4; TNFα and VEGF; TNFα and RANK ligand; TNFα and Blys; TNFα and GP130; TNFα and CD-22; and TNFα and CTLA-4.

In another embodiment the binding fusion proteins of the invention specifically bind to pairs of targets selected from, but not limited to CD138 and CD20; CD138 and CD40; CD19 and CD20; CD20 and CD3; CD38 & CD138 CD38 and CD20; CD38 and CD40; CD40 and CD20; CD-8 and IL-6; CSPGs and RGM A; CTLA4 and BTNO₂; IGF1 and IGF2; IGF1/2 and Erb2B; IL-12 and TWEAK; IL-13 and IL-1β; MAG and RGM A; NgR and RGM A; NogoA and RGM A; OMGp and RGM A; PDL-1 and CTLA4; RGM A and RGM B; Te38 and TNFα; TNFα and Blys; TNFα and CD-22; TNFα and CTLA-4; TNFα and GP130; TNFα and IL-12p40; and TNFα and RANK ligand.

The targeting moieties of the binding fusion proteins can be derived from one or more fragments of various monoclonal antibodies known in the art. Non-limiting examples of such monoclonal antibodies include, but are not limited to anti-TNF antibody (U.S. Pat. No. 6,258,562), anti-IL-12 and or anti-IL-12p40 antibody (U.S. Pat. No. 6,914,128); anti-IL-18 antibody (US 2005/0147610 A1), anti-RANKL (U.S. Pat. No. 7,411,050), anti-05, anti-CBL, anti-CD147, anti-gp120, anti-VLA4, anti-CD11a, anti-CD18, anti-VEGF, anti-CD40L, anti-Id, anti-ICAM-1, anti-CXCL13, anti-CD2, anti-EGFR, anti-TGF-beta 2, anti-E-selectin, anti-Fact VII, anti-Her2/neu, anti-Fgp, anti-CD11/18, anti-CD14, anti-ICAM-3, anti-CD80, anti-CD4, anti-CD3, anti-CD23, anti-beta2-integrin, anti-alpha4beta7, anti-CD52, anti-HLA DR, anti-CD22, anti-CD20, anti-MIF, anti-CD64 (FcR), anti-TCR alpha beta, anti-CD2, anti-Hep B, anti-CA 125, anti-EpCAM, anti-gp120, anti-CMV, anti-gpIIbIIIa, anti-IgE, anti-CD25, anti-CD33, anti-HLA, anti-VNRintegrin, anti-IL-1alpha, anti-IL-1beta, anti-IL-1 receptor, anti-IL-2 receptor, anti-IL-4, anti-IL4 receptor, anti-IL5, anti-IL-5 receptor, anti-IL-6, anti-IL-8, anti-IL-9, anti-IL-13, anti-IL-13 receptor, anti-IL-17, and anti-IL-23 (see Presta L G. 2005 Selection, design, and engineering of therapeutic antibodies J Allergy Clin Immunol. 116:731-6 and Clark, M., "Antibodies for Therapeutic Applications," Department of Pathology, Cambridge University, UK, 15 Oct. 2000, published online at M. Clark's home page at the website for the Department of Pathology, Cambridge University).

In some embodiments, the targeting moieties are derived from one or more fragments of therapeutic monoclonal antibodies approved for use in humans or antibodies that have demonstrated efficacy in clinical trials or established preclinical models of diseases, disorders or conditions. Such therapeutic antibodies include, but are not limited to, rituximab, IDEC/Genentech/Roche (see for example U.S. Pat. No. 5,736,137), a chimeric anti-CD20 antibody used in the treatment of many lymphomas, leukemias, and some autoimmune disorders; ofatumumab, an anti-CD20 antibody approved for use for chronic lymphocytic leukemia, and under development for follicular non-Hodgkin's lymphoma, diffuse large B cell lymphoma, rheumatoid arthritis and relapsing remitting multiple sclerosis, being developed by GlaxoSmithKline; lucatumumab (HCD122), an anti-CD40 antibody developed by Novartis for Non-Hodgkin's or Hodgkin's Lymphoma (see, for example, U.S. Pat. No. 6,899,879), AME-133, an antibody developed by Applied Molecular Evolution which binds to cells expressing CD20 to treat non-Hodgkin's lymphoma, veltuzumab (hA20), an antibody developed by Immunomedics, Inc. which binds to cells expressing CD20 to treat immune thrombocytopenic purpura, HumaLYM developed by Intracel for the treatment of low-grade B-cell lymphoma, and ocrelizumab, developed by Genentech which is an anti-CD20 monoclonal antibody for treatment of rheumatoid arthritis (see for example U.S. Patent Application 20090155257), trastuzumab (see for example U.S. Pat. No. 5,677,171), a humanized anti-Her2/neu antibody approved to treat breast cancer developed by Genentech; pertuzumab, an anti-Her2 dimerization inhibitor antibody developed by Genentech in treatment of in prostate, breast, and ovarian cancers; (see for example U.S. Pat. No. 4,753,894); cetuximab, an anti-EGRF antibody used to treat epidermal growth factor receptor (EGFR)-expressing, KRAS wild-type metastatic colorectal cancer and head and neck cancer, developed by Imclone and BMS (see U.S. Pat. No. 4,943,533; PCT WO 96/40210); panitumumab, a fully human monoclonal antibody specific to the epidermal growth factor receptor (also known as EGF receptor, EGFR, ErbB-1 and Her1, currently marketed by Amgen for treatment of metastatic colorectal cancer (see U.S. Pat. No. 6,235,883); zalutumumab, a fully human IgG1 monoclonal antibody developed by Genmab that is directed towards the epidermal growth factor receptor (EGFR) for the treatment of squamous cell carcinoma of the head and neck (see for example U.S. Pat. No. 7,247,301); nimotuzumab, a chimeric antibody to EGFR developed by Biocon, YM Biosciences, Cuba, and Oncosciences, Europe) in the treatment of squamous cell carcinomas of the head and neck, nasopharyngeal cancer and glioma (see for example U.S. Pat. No. 5,891,996; U.S. Pat. No. 6,506,883); alemtuzumab, a humanized monoclonal antibody to CD52 marketed by Bayer Schering Pharma for the treatment of chronic lymphocytic leukemia (CLL), cutaneous T-cell lymphoma (CTCL) and T-cell lymphoma; muromonab-CD3, an anti-CD3 antibody developed by Ortho Biotech/Johnson & Johnson used as an immunosuppressant biologic given to reduce acute rejection in patients with organ transplants; ibritumomab tiuxetan, an anti-CD20 monoclonal antibody developed by IDEC/Schering AG as treatment for some forms of B cell non-Hodgkin's lymphoma; gemtuzumab ozogamicin, an anti-CD33 (p67 protein) antibody linked to a cytotoxic chelator tiuxetan, to which a radioactive isotope is attached, developed by Celltech/Wyeth used to treat acute myelogenous leukemia; alefacept, an anti-LFA-3 Fc fusion developed by Biogen that is used to control inflammation in moderate to severe psoriasis with plaque formation; abciximab, made from the Fab fragments of an antibody to the IIb/IIIa receptor on the platelet membrane developed by Centocor/Lilly as a platelet aggregation inhibitor mainly used during and after coronary artery procedures; basiliximab, a chimeric mouse-human monoclonal antibody to the α chain (CD25) of the IL-2 receptor of T cells, developed by Novartis, used to prevent rejection in organ transplantation; palivizumab, developed by Medimmune; infliximab (REMICADE), an anti-TNFalpha antibody developed by Centocor/Johnson and Johnson, adalimumab (HUMIRA), an anti-TNFalpha antibody developed by Abbott, HUMICADE, an anti-TNFalpha antibody developed by Celltech, etanercept (ENBREL), an anti-TNFalpha Fc fusion developed by Immunex/Amgen, ABX-CBL, an anti-CD147 antibody developed by Abgenix, ABX-IL8, an anti-IL8 antibody developed by Abgenix, ABX-MA1, an anti-MUC18 antibody developed by Abgenix, Pemtumomab (R1549, 90Y-muHMFG1), an anti-MUC1 in development by Antisoma, Therex (R1550), an anti-MUC1 antibody developed by Antisoma, AngioMab (AS1405), developed by Antisoma, HuBC-1, developed by Antisoma, Thioplatin (AS1407) developed by Antisoma, ANTEGREN (natalizumab), an anti-alpha-4-beta-1 (VLA4) and alpha-4-beta-7 antibody developed by Biogen, VLA-1 mAb, an anti-VLA-1 integrin antibody developed by Biogen, LTBR mAb, an anti-lymphotoxin beta receptor (LTBR) antibody developed by Biogen, CAT-152, an anti-TGF-β2 antibody developed by Cambridge Antibody Technology, J695, an anti-IL-12 antibody developed by Cambridge Antibody Technology and Abbott, CAT-192, an anti-TGFβ1 antibody developed by Cambridge Antibody Technology and Genzyme, CAT-213, an anti-Eotaxin1 antibody developed by Cambridge Antibody Technology, LYMPHOSTAT-B, an anti-Blys antibody developed by Cambridge Antibody Technology and Human Genome Sciences Inc., TRAIL-R1mAb, an anti-TRAIL-R1 antibody developed by Cambridge Antibody Technology and Human Genome Sciences, Inc., bevacizumab (AVASTIN, rhuMAb-VEGF), an anti-VEGF antibody developed by Genentech, HERCEPTIN, an anti-HER receptor family antibody developed by Genentech, Anti-Tissue Factor (ATF), an anti-Tissue Factor antibody developed by Genentech, XOLAIR (Omalizumab), an anti-IgE antibody developed by Genentech, MLN-02 Antibody (formerly LDP-02), developed by Genentech and Millennium Pharmaceuticals, HUMAX CD4®, an anti-CD4 antibody developed by Genmab, tocilizuma, and anti-IL6R antibody developed by Chugai, HUMAX-IL15, an anti-IL15 antibody developed by Genmab and Amgen, HUMAX-Inflam, developed by Genmab and Medarex, HUMAX-Cancer, an anti-Heparanase I antibody developed by Genmab and Medarex and Oxford GlycoSciences, HUMAX-Lymphoma, developed by Genmab and Amgen, HUMAX-TAC, developed by Genmab, IDEC-131, and anti-CD40L antibody developed by IDEC Pharmaceuticals, IDEC-151 (Clenoliximab), an anti-CD4 antibody developed by IDEC Pharmaceuticals, IDEC-114, an anti-CD80 antibody developed by IDEC Pharmaceuticals, IDEC-152, an anti-CD23 developed by IDEC Pharmaceuticals, anti-macrophage migration factor (MIF) antibodies developed by IDEC Pharmaceuticals, BEC2, an anti-idiotypic antibody developed by Imclone, IMC-1C11, an anti-KDR antibody developed by Imclone, DC101, an anti-flk-1 antibody developed by Imclone, anti-VE cadherin antibodies developed by Imclone, CEA-CIDE (labetuzumab), an anti-carcinoembryonic antigen (CEA) antibody developed by Immunomedics, Yervoy (ipilimumab), an anti-CTLA4 antibody developed by Bristol-Myers Sequibb in the treatment of melanoma, LYMPHOCIDE (Epratuzumab), an anti-CD22 antibody developed by Immunomedics, AFP-Cide, developed by Immunomedics, MyelomaCide, developed by Immunomedics, LkoCide, developed by Immunomedics, ProstaCide, developed by Immunomedics, MDX-010, an anti-CTLA4 antibody developed by Medarex, MDX-060, an anti-CD30 antibody developed by Medarex, MDX-070 developed by Medarex, MDX-018 developed by Medarex, OSIDEM (IDM-1), and anti-Her2 antibody developed by Medarex and Immuno-Designed Molecules, HUMAX®-CD4, an anti-CD4 antibody developed by Medarex and Genmab, HuMax-IL15, an anti-IL15 antibody developed by Medarex and Genmab, CNTO 148, an anti-TNFa antibody developed by Medarex and Centocor/J&J, CNTO 1275, an anti-cytokine antibody developed by Centocor/J&J, MOR101 and MOR102, anti-intercellular adhesion molecule-1 (ICAM-1) (CD54) antibodies developed by MorphoSys, MOR201, an anti-fibroblast growth factor receptor 3 (FGFR-3) antibody developed by MorphoSys, tremelimumab, an anti-CTLA-4 antibody developed by Pfizer, visilizumab, an anti-CD3 antibody developed by Protein Design Labs, HUZAF, an anti-gamma interferon antibody developed by Protein Design Labs, Anti-a 5β1 Integrin, developed by Protein Design Labs, anti-IL-12, developed by Protein Design Labs, ING-1, an anti-Ep-CAM antibody developed by Xoma, XOLAIR® (Omalizumab) a humanized anti-IgE antibody developed by Genentech and Novartis, and MLN01, an anti-Beta2 integrin antibody developed by Xoma; all of the above-cited antibody references in this paragraph are expressly incorporated herein by reference. The sequences for the above antibodies can be obtained from publicly available databases, patents, or literature references.

1. Exemplary Targeting Moieties

The following section provides a non-limiting list and description of exemplary targeting moieties and their use in binding fusion proteins.

Anti-Her2:

In one embodiment, the invention provides an isolated anti-Her2 binding fusion protein.

"Anti-Her2" means a targeting moiety that specifically binds to the extracellular domain of the HER2/neu receptor (a.k.a. erbB-2 protein), including antibodies, antibody fragments, fragment dimers, traps, and other polypeptides with binding affinity to the domain IV of the HER2/erbB-2 protein. The HER2-encoding gene is found on band q21 of chromosome 17, generates a messenger RNA (mRNA) of 4.8 kb, and the protein encoded by the HER2 gene is 185,000 Daltons. In normal subject, ligands that bind to the HER2 receptor promote dimerization with other receptors, resulting in signal transduction and activation of the PI3K/Akt pathway and the MAPK pathway.

In approximately 25% of breast cancers, the HER2 gene is amplified by 2-fold to greater than 20-fold in each tumor cell nucleus relative to the number of copies of chromosome 17. Amplification of the HER2gene drives protein expression and the resulting increase in the number of receptors at the tumor-cell surface promotes receptor activation, leading to signaling, excessive cellular division, and the formation of tumors (Hicks, D G et al., HER2+ breast cancer: review of biologic relevance and optimal use of diagnostic tools. Am J Clin Pathol. (2008) 129(2):263-73).

The anti-Her2 used as a fusion partner with XTEN creates a binding fusion protein composition that has can have therapeutic utility when administered to a subject by binding to the extracellular domain of the extracellular segment of the HER2/neu receptor. Such binding can interfere with receptor dimerization and the resulting activation of EGFR intrinsic tyrosine kinase function (Yarden et al, Biochemistry, (1988), 27, 3114-3118; Schlessinger, Biochemistry, (1988), 27, 3119-3123), with the result that cells with bound receptors undergo arrest during the G1 phase of the cell cycle so there is reduced proliferation of tumor cells, as well as suppression of angiogenesis.

One object of the invention is to provide novel anti-Her2 binding fusion proteins comprising one or more binding moieties that specifically bind to erbB-2 protein and that do not substantially bind to normal human cells, which may be utilized for the treatment or prevention of erbB-2 expressing tumor cells, or for the immunological detection of erbB-2 expressing tumor cells. The CDR and FR residues of a humanized HER2 antibody have been reported in Carter et al., Proc. Natl. Acad. Sci. USA, 89:4285 (1992). In one embodiment, the anti-Her2 antibody compositions comprise a single anti-Her2 targeting moiety linked to at least a first XTEN. In another embodiment, the anti-Her2 compositions comprise a first and a second anti-Her2 targeting moiety, which may be the same or which may bind different epitopes of the erbB-2 protein. In one embodiment, the anti-Her2 component of a binding fusion protein comprises one or more complementarity determining regions (CDRs) of trastuzumab capable of binding to the domain IV of the extracellular segment of the HER2/neu receptor.

Another embodiment of the invention relates to a method of inhibiting growth of tumor cells by administering to a patient a therapeutically effective amount of anti-Her2 binding fusion protein composition capable of inhibiting the HER2 receptor function. A further embodiment of the invention relates to administering a therapeutically effective amount of anti-Her2 composition capable of inhibiting growth factor receptor function, and a therapeutically effective amount of a cytotoxic factor. Still another object of the invention is to provide methods for the treatment and/or prevention of erbB-2 receptor over-expressing tumors comprising the administration of an anti-tumor effective amount of at least one of the disclosed anti-Her2 fusion proteins capable of binding to cancer cells associated by the over-expression of erbB-2 protein. In another embodiment, the invention provides a method for the treatment and/or prevention of erbB-2 receptor over-expressing tumors comprising the administration of therapeutically-effective amounts of anti-Her2 fusion protein comprising a first and a second anti-Her2 binding moiety, which may be the same or which may bind different epitopes of the erbB-2 protein, capable of inhibiting the HER2 receptor function. Preferably, such combinations of binding moieties will exhibit better cytotoxic activity than would be expected for the sum of the cytotoxic activity of the individual antibodies at the same overall antibody concentration. Additionally, one or more of the administered antibodies may be conjugated to a cytotoxic moiety, e.g., an anti-tumor drug, toxin, or radionuclide.

Anti-RSV:

In another embodiment, the invention provides an isolated anti-RSV binding fusion protein. "Anti-RSV" means a targeting moiety that specifically binds to surface antigens of respiratory syncytial virus (RSV). An anti-RSV can be an antibody or fragment thereof that neutralizes RSV, preventing its ability to establish an infection in a mammal, or that contributes to the clearance of RSV from an infected host. The anti-RSV can be used as a fusion partner with XTEN to create a fusion protein composition that has prophylactic or therapeutic utility when administered to a subject, such as an infant at risk for RSV infection. In one embodiment, the anti-RSV component of a binding fusion protein comprises one or more complementarity determining regions (CDRs) of palivizumab. Antibodies to RSV have been described in U.S. Pat. No. 5,824,307.

Anti-cMet:

In another embodiment, the invention provides an isolated anti-cMet binding fusion protein. "Anti-cMet" means a targeting moiety that specifically binds to Met, or hepatocyte growth factor (HGF) receptor. MET is a proto-oncogene, with the encoded hepatocyte growth factor receptor (HGFR) or cMet having tyrosine-kinase activity essential for embryonic development and wound healing. Upon HGF binding and stimulation, MET induces several biological responses that collectively give rise to invasive growth. Abnormal MET activation in cancer correlates with poor prognosis, where aberrantly active MET triggers tumor growth, angiogenesis and formation of new blood vessels that supply the tumor with nutrients, and cancer spread to other organs (metastasis). MET is deregulated in many types of human malignancies, including cancers of kidney, liver, stomach, breast, and brain. Anti-cMET can be an targeting moiety that specifically binds to a HGF receptor, serving as an antagonist to HGF. The anti-cMET can be used as a fusion partner with XTEN to create a fusion protein composition that has prophylactic or therapeutic utility when administered to a subject for the treatment of MET-expressing tumors. In one embodiment, the anti-cMET component of a binding fusion protein comprises one or more complementarity determining regions (CDRs) of the antibody MetMab or PRO143966. Antibodies to cMet and their sequences have been described in U.S. Pat. No. 5,686,292. U.S. Pat. No. 6,468,529 U.S. Pat. No. 7,476,724 and U.S. Patent Application Publication No. 20070092520.

Anti-IL6R:

In another embodiment, the invention provides an isolated anti-IL6R binding fusion protein. "Anti-IL6R" means a targeting moiety that specifically binds to an IL-6 receptor. Anti-IL6R can serve as an antagonist to IL-6. The anti-IL6R can be used as a fusion partner with XTEN to create a fusion protein composition that has prophylactic or therapeutic utility when administered to a subject for inflammatory conditions, such as arthritis or Crohn's disease. Tocilizuma has been shown to have clinical utility in moderate to severe rheumatoid arthritis, and has been approved by the FDA. In one embodiment, the anti-IL6R component of a binding fusion protein comprises one or more complementarity determining regions (CDRs) of tocilizuma. Antibodies to IL-6R have been described in U.S. Pat. Nos. 5,670,373, 5,795,965, 5,817,790, and 7,479,543.

Anti-IL17:

In another embodiment, the invention provides an isolated anti-IL17 binding fusion protein. "Anti-IL17" means a targeting moiety that specifically binds to the cytokine IL-17. IL-17 is a disulfide-linked homodimeric cytokine of about 32 kDa which is synthesized and secreted only by CD4+activated memory T cells (reviewed in Fossiez et al., Int. Rev. Immunol., 16: 541-551 (1998)). Interleukin (IL-17) is a pro-inflammatory T cell cytokine that is expressed, for example, in the synovial fluid of patients with rheumatoid arthritis. IL-17 is a potent inducer of various cytokines such as TNF and IL-1, and IL-17 has been shown to have additive or even synergistic effects with TNF and IL-1. The anti-IL17 can be used as a fusion partner with XTEN to create a binding fusion protein composition that has prophylactic or therapeutic utility when administered to a subject for inflammatory conditions, such as arthritis or Crohn's disease, or in multiple sclerosis. LY2439821 is an antibody that has shown utility, when added to oral DMARDs, in improving signs and symptoms of rheumatoid arthritis. In one embodiment, the anti-IL6R component of a binding fusion protein comprises one or more complementarity determining regions (CDRs) of LY2439821. Anti-IL17 antibodies have been described in US Patent Application Nos. 20050147609 and 20080269467 and PCT application publication WO 2007/070750.

IL17R:

In another embodiment, the invention provides an isolated IL17R binding fusion protein. "IL17R" means a targeting moiety that specifically binds to the cytokine receptor for IL-17. Studies have shown that contacting T cells with a soluble form of the IL-17 receptor polypeptide inhibited T cell proliferation and IL-2 production induced by PHA, concanavalin A and anti-TCR monoclonal antibody (Yao et al., J. Immunol, 155:5483-5486 [1995]). As interleukin (IL-17) is a pro-inflammatory T cell cytokine that is a potent inducer of various cytokines such as TNF and IL-1, the IL17R can be used as a fusion partner with XTEN to create a binding fusion protein composition to bind and neutralize IL-17. The IL17R can have therapeutic utility when administered to a subject for inflammatory conditions, such as rheumatoid arthritis or Crohn's disease. IL7R receptors and homologs have been cloned, as described in U.S. Pat. No. 5,869,286.

Anti-IL12:

In another embodiment, the invention provides an isolated anti-IL12 binding fusion protein. "Anti-IL12" means a targeting moiety that specifically binds to the cytokine IL-12 and, in some cases, IL-23. Biologically active IL-12 exists as a heterodimer comprised of 2 covalently linked subunits of 35 (p35) and 40 (p40) kD, the latter being known as IL-23. IL-12 is a cytokine that is an important part of the inflammatory response, and stimulates the production of interferon-gamma (IFN-γ) and tumor necrosis factor-alpha (TNF-α) from T and natural killer (NK) cells, and reduces IL-4 mediated suppression of IFN-γ. T cells that produce IL-12 have a coreceptor, CD30, which is associated with IL-12 activity. IL-12 has also been linked with autoimmunity and with psoriasis, with the interaction between T lymphocytes and stem cell keratinocytes that produce IL-12 being of significance. Ustekinumab is an anti-IL12/23 antibody that has demonstrated utility in the treatment of moderate to severe plaque psoriasis, and has been approved by the FDA. The anti-IL-12 can be used as a fusion partner with XTEN to create a fusion protein composition that has therapeutic utility when administered to a subject suffering from inflammatory conditions, such as, but not limited to, psoriasis, rheumatoid arthritis or Crohn's disease. In one embodiment, the anti-IL12 component of a binding fusion protein comprises one or more complementarity determining regions (CDRs) of the antibody ustekinumab. Antibodies to IL-12 and their use have been described in U.S. Pat. No. 7,279,157.

Anti-IL23:

In another embodiment, the invention provides an isolated anti-IL23 binding fusion protein. "Anti-IL23" means a targeting moiety that specifically binds to the cytokine IL-23. IL-23 is the name given to a factor that is composed of the p40 subunit of IL-12, and is a pro-inflammatory cytokine that is an important part of the inflammatory response against infection. IL-23 promotes upregulation of the matrix metalloprotease MMP9, increases angiogenesis and reduces CD8+ T-cell infiltration. IL-23 has been demonstrated to play a role in psoriasis, multiple sclerosis and inflammatory bowel. Ustekinumab is an anti-IL23 antibody that has demonstrated utility in psoriasis. The anti-IL-23 can be used as a fusion partner with XTEN to create a fusion protein composition that has therapeutic utility when administered to a subject suffering from inflammatory conditions, such as, but not limited to, psoriasis, rheumatoid arthritis or Crohn's disease. In one embodiment, the anti-IL23 component of a binding fusion protein comprises one or more complementarity determining regions (CDRs) of the antibody ustekinumab. Antibodies to IL-23 have been described in U.S. Pat. Nos. 7,491,391 and 7,247,711.

Anti-RANKL:

In another embodiment, the invention provides an isolated anti-RANKL binding fusion protein. "Anti-RANKL" means a targeting moiety that specifically binds to the protein RANKL (receptor activator of nuclear factor kappa B Ligand or RANK ligand). RANKL is a protein that acts as the primary signal to promote bone removal, driven by osteoclasts, which break bone down. In many bone loss conditions, RANKL overwhelms the body's natural defense against bone destruction. The anti-RANKL can be used as a fusion partner with XTEN to create a fusion protein composition that has therapeutic utility when administered to a subject by inhibiting the maturation of osteoclasts by binding to RANKL, protecting the bone from degradation and thus from osteoporosis. The binding fusion protein therefore mimics the endogenous effects of osteoprotegerin, another protein produced by osteoblasts which acts as an alternate receptor for RANKL, modulating the RANK/RANKL induced osteoclast activity. Antibodies to RANKL, such as denosumab, have demonstrated efficacy in Phase III trials demonstrated in postmenopausal osteoporosis. In one embodiment, the anti-RANKL component of a binding fusion protein comprises one or more complementarity determining regions (CDRs) of the antibody denosumab. Anti-RANKL antibodies have been described in U.S. Pat. No. 7,411,050.

CTLA4:

In another embodiment, the invention provides an isolated CTLA4 binding fusion protein. "CTLA4" means a targeting moiety that specifically binds to CD80 and CD86 on antigen-presenting cells, and can specifically bind B7. The CTLA4 can be used as a fusion partner with XTEN to create a fusion protein composition that has therapeutic utility when administered to a subject suffering from inflammatory conditions, such as, but not limited to, rheumatoid arthritis, psoriasis and in organ transplantation. Belatacept is a fusion protein composed of the Fc fragment of a human IgG1 immunoglobulin linked to the extracellular domain of CTLA-4 that has shown efficacy in providing extended graft survival. In one embodiment, the CTLA4 binding component of the binding fusion protein comprises one or more binding regions from belatacept. The cloning and use of CTLA4 compositions have been described in U.S. Pat. Nos. 5,434,131, 5,773,253, 5,851,795, 5,885,579, 7,094,874, and 7,439,230.

ANTI-CD3:

In another embodiment, the invention provides an isolated anti-CD3 binding fusion protein. "Anti-CD3" means a targeting moiety that specifically binds to CD3 T-cell receptor. T-Cell Co-Receptor is a protein complex composed of four distinct chains; a CD3γ chain, a CD3δ chain, and two CD3ε chains. These chains associate with a molecule known as the T cell receptor (TCR) and the ζ-chain to generate an activation signal in T lymphocytes. Anti-CD3 monoclonal antibodies suppress immune responses by transient T-cell depletion and antigenic modulation of the CD3/T-cell receptor complex. For example, anti-CD3 treatment of adult nonobese diabetic (NOD) mice, a spontaneous model of T-cell-mediated autoimmune insulin-dependent diabetes mellitus, can inhibit the autoimmune process leading to diabetes. The use of anti-CD3 antibodies to treat diseases and disorders has been described, for example, in U.S. Pat. No. 4,515,893. In one embodiment, the CD3 binding component of the binding fusion protein comprises one or more complementarity determining regions (CDRs) of the antibody Muromonab-CD3.

ANTI-CD40:

In another embodiment, the invention provides an isolated anti-CD40 binding fusion protein. "Anti-CD40" means a targeting moiety that specifically binds to the cell-surface receptor CD-40. CD-40 is a cell-surface receptor that plays a role in immune responses, as well as cell growth and survival signaling when activated by CD40 ligand (CD40L). CD40 is commonly over-expressed and activated in B-cell malignancies, such as multiple myeloma and lymphoma. The anti-CD40 can be used as a fusion partner with XTEN to create a fusion protein composition that can have therapeutic utility when administered to a subject suffering from various cancers, particularly B-cell malignancies. In one embodiment, the anti-CD40 component of a binding fusion protein comprises one or more complementarity determining regions (CDRs) of the antibody lucatumumab. Anti-CD40 antibodies have been described in U.S. Pat. No. 7,445,780, and U.S. Patent Appl. Nos. 20070110754 and 20080254026.

ANTI-TNFalpha:

In another embodiment, the invention provides an isolated anti-TNFalpha binding fusion protein. "Anti-TNFalpha" means a targeting moiety that specifically binds to the cytokine TNFalpha. TNFalpha, or cachexin, is a pro-inflammatory cytokine involved in systemic inflammation and is a member of a group of cytokines that stimulate the acute phase reaction. The primary role of TNF is in the regulation of immune cells. TNF is produced mainly by macrophages, but is also produced by lymphoid cells, mast cells, endothelial cells, cardiac myocytes, adipose tissue, fibroblasts, and neuronal tissue. Large amounts of TNF are released in response to lipopolysaccharide and Interleukin-1 (IL-1). TNF has been implicated in autoimmune disorders such as rheumatoid arthritis, ankylosing spondylitis, Crohn's disease, psoriasis and refractory asthma, and plays a role in septic shock and other serious forms of acute inflammatory response and SIRS. The anti-IL-TNFalpha can be used as a fusion partner with XTEN to create a fusion protein composition that can have therapeutic utility in a wide variety of inflammatory disorders, including rheumatoid arthritis, ankylosing spondylitis, Crohn's disease, psoriasis and refractory asthma. Anti-TNFalpha antibodies, such as infliximab and etanercept have shown efficacy in psoriasis, Crohn's disease, ankylosing spondylitis, psoriatic arthritis, rheumatoid arthritis and ulcerative colitis. In one embodiment, the anti-TNFalpha component of a binding fusion protein comprises one or more complementarity determining regions (CDRs) or binding regions of the infliximab or etanercept. Anti-TNF antibodies have been described in U.S. Pat. No. 6,790,444, and chimeric antibodies comprising a TNF receptor have been described in U.S. Pat. No. 5,605,690.

The invention provides binding fusion protein compositions in which the binding regions of the foregoing referenced exemplary targeting moieties are sequence variants. For example, it will be appreciated that various amino acid deletions, insertions and substitutions can be made in the targeting moiety to create variants without departing from the spirit of the invention with respect to the binding activity or the pharmacologic properties of the binding fusion protein. Examples of conservative substitutions for amino acids in polypeptide sequences are shown in Table 5. However, in embodiments of the binding fusion protein in which the sequence identity of the targeting moiety is less than 100% compared to a specific sequence referenced or disclosed herein, the invention contemplates substitution of any of the other 19 natural L-amino acids for a given amino acid residue of the given targeting moiety, which may be at any position within the sequence of the targeting moiety or binding region of the targeting moiety, including adjacent amino acid residues. If any one substitution results in an undesirable change in binding activity, then one of the alternative amino acids can be employed and the construct protein evaluated by the methods described herein (e.g., the assays of the Examples), or using any of the techniques and guidelines for conservative and non-conservative mutations set forth, for instance, in U.S. Pat. No. 5,364,934, the contents of which is incorporated by reference in its entirety, or using methods generally known in the art. In addition, variants can include, for instance, polypeptides wherein one or more amino acid residues are added or deleted at the N- or C-terminus of the referenced or disclosed amino acid sequence of a targeting moiety that retains some if not all of the binding activity of the referenced or disclosed targeting moiety; e.g., the ability to bind a target of Table 1 or Table 2.

TABLE 5

Exemplary conservative amino acid substitutions

| Original Residue | Exemplary Substitutions |
|---|---|
| Ala (A) | val; leu; ile |
| Arg (R) | Lys; Gln; Asn |
| Asn (N) | Gln; His; Llys; Arg |
| Asp (D) | Glu |
| Cys (C) | Ser |
| Gln (Q) | Asn |
| Glu (E) | Asp |
| Gly (G) | Pro |
| His (H) | Asn; Gln; Lys; Arg |
| Ile (I) | Leu; Val; Met; Ala; Phe; Norleucine |
| Leu (L) | Norleucine; Ile: Val; Met; Ala: Phe |
| Lys (K) | Arg' Gln; Asn |
| Met (M) | Leu; Phe; Ile |
| Phe (F) | Leu; Val; i = Lle; Ala |
| Pro (P) | Gly |
| Ser (S) | Thr |
| Thr (T) | Ser |
| Trp (W) | Tyr |
| Tyr(Y) | Trp; Phe: Thr; Ser |
| Val (V) | Ile; Leu; Met; Phe; Ala; Norleucine |

2. Exemplary Forms of Targeting Moieties

The following section provides a non-limiting list and description of exemplary forms of targeting moieties.

"Antibody" or "antibodies", as used here, refers to a targeting moiety consisting of one or more polypeptides substantially encoded by immunoglobulin genes or fragments of immunoglobulin genes, and is used in the broadest sense to cover intact monoclonal antibodies, multispecific antibodies (e.g. bispecific antibodies) formed from at least two intact antibodies or fragment thereof, and antibody fragments so long as they exhibit the desired biological activity; e.g., binding affinity to a target ligand or antigen.

Immunoglobulins can be assigned to different classes depending on the amino acid sequence of the constant domain of their heavy chains. There are five major classes of immunoglobulins: IgA, IgD, IgE, IgG, and IgM, and several of these may be further divided into subclasses (isotypes), e.g., IgG1, IgG2, IgG3, IgG4, IgA1, and IgA2. The heavy-chain constant domains that correspond to the different classes of immunoglobulins are called $\alpha$, $\delta$, $\epsilon$, $\gamma$, and $\mu$, respectively. The subunit structures and three-dimensional configurations of different classes of immunoglobulins are well known.

The term "monoclonal" indicates the character of the targeting moiety antibody or antibody fragment as being obtained from a substantially homogeneous population of antibodies or fragments, and is not to be interpreted as requiring production of the antibody by a particular method. For example, while the monoclonal antibodies created in accordance with the methods of the present invention may be made by the hybridoma method first described by Kohler et al., Nature, 256:495 (1975), they may also be synthetics made by recombinant DNA methods (see, e.g., U.S. Pat. No. 4,816, 567) and expressed in either mammalian or non-mammalian hosts; e.g., E. coli. The substitution of immortalized cells with bacterial cells considerably simplifies procedures for preparing large amounts of the inventive binding fusion protein molecules. Furthermore, a recombinant production system allows the ability to produce tailor-made antibodies and fragments thereof, or even libraries to screen for specific attributes. For example, it is possible to produce chimeric molecules with new combinations of binding and effector functions, humanized antibodies and novel antigen-binding molecules, including bifunctional binding fusion proteins. Furthermore, the use of polymerase chain reaction (PCR) amplification (Saiki, R. K., et al., Science 239, 487-491 (1988)) to introduce variations into the sequence and isolate antibody producing sequences from cells has great potential for speeding up the timescale under which specificities can be isolated. Amplified $V_H$ and $V_L$ genes can be cloned directly into vectors for expression in bacteria or mammalian cells (Orlandi, R., et al., 1989, Proc. Natl. Acad. Sci., USA 86, 3833-3837; Ward, E. S., et al., 1989 supra; Larrick, J. W., et al., 1989, Biochem. Biophys. Res. Commun. 160, 1250-1255; Santry, L. et al., 1989, Proc. Natl. Acad. Sci., USA, 86, 5728-5732). Soluble antibody fragments secreted from bacteria can then be screened in binding assays described herein, or others known in the art, to select those constructs with binding activities sufficient to meet the application.

The monoclonal antibodies herein specifically include "chimeric" antibodies in which a portion of the heavy and/or light chain is identical with or has a high degree of homology to corresponding parental sequences in antibodies derived from a particular first species, while the remainder of the chain(s) is identical with or has a high degree of homology to sequences in antibodies derived from a second species, wherein the resulting antibody exhibits the desired biological activity; e.g., binding affinity for the target antigen or ligand (U.S. Pat. No. 4,816,567; Morrison et al., Proc. Natl. Acad. Sci. USA, 81:6851-4855 (1984)).

The term "humanized" means forms of antibodies, including fragments, that are chimeric in that they include minimal sequence derived from non-human immunoglobulin but otherwise comprise sequence from human immunoglobulins. Methods for humanizing non-human antibodies have been described in the art. Preferably, a humanized antibody has one or more amino acid residues introduced into it from a source which is non-human (e.g., murine, rat, or non-human primate) and that are typically taken from a variable domain of a $V_L$ or $V_H$ chain having the desired specificity and affinity for the target ligand. Humanization can be essentially performed following the method of Winter and co-workers (Jones et al., Nature, 321:522-525 (1986); Riechmann et al., Nature, 332: 323-327 (1988); Verhoeyen et al., Science, 239:1534-1536 (1988)), by substituting hypervariable region sequences for the corresponding sequences of a human antibody. Accordingly, such "humanized" antibodies are chimeric antibodies (see, e.g., U.S. Pat. No. 4,816,567) wherein all or a portion of the human variable domain has been substituted by the corresponding sequence from a non-human species. In practice, humanized antibodies are typically human antibodies in which some hypervariable CDR residues and possibly some FR residues are substituted by residues from analogous sites in rodent (or other non-human species, e.g., non-human primates) antibodies. In one embodiment, humanized antibodies comprise residues that are not found in the recipient antibody or in the donor antibody to, for example, increase binding affinity or some other property. In general, humanized antibodies comprise substantially all of at least one, and typically two, variable domains, in which all or substantially all of the hypervariable loops correspond to or have sequences derived from those of a non-human immunoglobulin and all or substantially all of the FR regions are those of a human immunoglobulin sequence. The humanized antibody can optionally comprise at least a portion of an immunoglobulin constant region (Fc), preferably that of a human immunoglobulin.

The targeting moieties of the subject compositions can be derived from humanized antibodies. The choice of human variable domains, both light and heavy, to be used in the compositions is very important to reduce antigenicity of the antibody. For example, the sequence of the variable domain of a rodent antibody can be screened against a library of known human variable-domain sequences in order to select a sequence that is less likely to elicit an immune response in the recipient. In a corresponding fashion, the human sequence that is closest to that of the rodent can be used as the human framework (FR) for the humanized antibody (Sims et al., J. Immunol, 151:2296 (1993); Chothia et al., J. Mol. Biol., 196: 901 (1987)). The same framework may be used for several different humanized antibodies (Carter et al., Proc. Natl. Acad. Sci. USA, 89:4285 (1992); Presta et al., J. Immunol., 151:2623 (1993)).

An additional property is that targeting moieties can be humanized yet retain high affinity for the antigen and other favorable biological properties. To achieve this goal, according to a preferred method, humanized targeting moieties are prepared by an iterative process of analysis of the parental sequences and various conceptual humanized products using three-dimensional models of the parental and humanized sequences followed by testing. Three-dimensional immunoglobulin models are commonly available and are familiar to those skilled in the art. Computer programs are available which illustrate and display probable three-dimensional conformational structures of selected candidate immunoglobulin sequences. Inspection of these displays permits analysis of the likely role of the residues in the functioning of the candidate immunoglobulin sequence, i.e., the analysis of residues that influence the ability of the candidate immunoglobulin to bind its antigen. In this way, FR residues can be selected and combined from the recipient and donor using standard recombinant DNA techniques so that the desired characteristic, such as increased affinity for the target antigen(s), can be achieved. In one embodiment, binding fusion protein constructs are created in which a sequence comprising linked heavy chain variable domains is linked to a heavy chain constant domain and sequence comprising linked light chain variable domains is linked to a light chain constant domain. Preferably the constant domains are human heavy chain constant domain and human light chain constant domain respectively. In a further embodiment of the foregoing, the fusion protein can be designed to include portions or all of a hinge region in order to permit dimerization of the binding fusion protein, and which can further comprise an XTEN linked to the C-terminus of the constant region. In an alternative embodiment, the binding fusion protein can be designed to incorporate a partial Fc without a hinge and with a CH2 domain that is truncated but retains FcRn binding in order to confer longer terminal half-life on the construct. In yet another embodiment, the binding fusion protein can be designed to incorporate a partial Fc without hinge but with a CH2 and CH3 domain, which can dimerize via the CH3 domain. In the embodiments hereinabove described in this paragraph, an XTEN can be linked to either the N- or C-terminus of the fusion protein, to enhance one or more properties of the resulting bind fusion protein.

"Antibody fragments" comprise a portion of an intact antibody or a synthetic or chimeric counterpart, preferably the antigen binding or variable region of the intact antibody. Examples of antibody fragments include molecules such as Fab fragments, Fab' fragments, F(ab')$_2$ fragments, Fd fragments, Fabc fragments, Fd fragments, Fabc fragments, domain antibodies ($V_{HH}$), single-chain antibody molecules (scFv), diabodies, individual antibody light chains, individual antibody heavy chains, chimeric fusions between antibody chains and other molecules, and the like.

A "Fab fragment" refers to a region of an antibody which binds to antigens. A Fab fragment is composed of one constant and one variable domain of each of the heavy and the light chain. These domains shape the paratope—the antigen binding site—at the amino terminal end of the monomer. The two variable domains bind the epitope on their specific antigens. A Fab fragment can be linked by a disulfide bond at the C-terminus. Fab fragments can be generated in vitro. For example, the enzyme papain can be used to cleave an immunoglobulin monomer into two Fab fragments and an Fc fragment. The enzyme pepsin cleaves below the hinge region, so a F(ab')$_2$ fragment and a Fc fragment is formed. As described more fully below, variable regions of the heavy and light chains can be fused together to form a single chain variable fragment (scFv), which retains the original specificity of the parent immunoglobulin.

The "light chains" of antibodies (immunoglobulins) from any vertebrate species can be assigned to one of two clearly distinct types, called kappa and lambda, based on the amino acid sequences of their constant domains.

The term "variable" refers to the fact that portions of the variable domains differ extensively in sequence among antibodies and confer the binding specificity of each particular antibody for its particular antigen. The variability is concentrated in three segments called complementarity-determining regions (CDRs) or hypervariable regions, both in the light-chain and the heavy-chain variable domains; i.e., CDR1, CDR2 and CDR3. In particular, the CDR regions from antibodies can be incorporated into targeting moieties of the subject compositions, but can be individually selected from one or more antibodies to create the binding domain. The more highly conserved portions of variable domains are called the framework regions (FR), which may also be incorporated into targeting moieties. The variable domains of native heavy and light chains each comprise four FR regions, typically adopting a β-sheet configuration, connected by three CDRs that form loops. The CDRs in each chain are held together in close proximity by the FR regions and, with the CDRs from the other chain, contribute to the formation of the antigen-binding site of antibodies (see Kabat et al., *NIH Publ. No.* 91-3242, Vol. I, pages 647-669 (1991)). The constant domains are not involved directly in binding an antibody to an antigen, but exhibit or participate in various effector functions, such as antibody-dependent cellular toxicity.

Single-Chain Variable Fragment Binding Fusion Proteins

In one aspect, the present invention provides single-chain variable fragment binding fusion protein compositions. The term "single-chain variable fragment" or "scFv" means an antibody fragment that comprises one $V_H$ and one $V_L$ domain of an antibody, wherein these domains are present in a single polypeptide chain, and are generally joined by a polypeptide linker between the domains that enables the scFv to form the desired structure for antigen binding. Methods for making scFv's are known in the art (see, e.g., U.S. Pat. No. 6,806,079; Bird et al. (1988) Science 242:423-426; Huston et al. (1988) PNAS 85:5879-5883; Pluckthun in *The Pharmacology of Monoclonal Antibodies*, vol. 113, Rosenburg and Moore eds. Springer-Verlag, New York, pp. 269-315 (1994)).

A binding domain of the scFv binding fusion protein compositions of the invention can have the N— to C-terminus configuration VH-linker-VL or VL-linker-VH. The binding fusion proteins would include at least a first XTEN and optionally a second XTEN sequence linked to the N- or C-terminus of the fusion protein (as shown in FIG. 1), resulting in at least the following structure permutations (N- to C-terminus); XTEN-VH-linker-VL; VH-linker-VL-XTEN; XTEN-VH-linker-VL-XTEN; XTEN-VL-linker-VH; VL-linker-VH-XTEN; XTEN-VL-linker-VH-XTEN. In one embodiment of the foregoing, the composition comprises an XTEN linked to the N-terminus of the fusion protein, wherein the expression of the fusion protein in a host cell transformed with a suitable expression vector comprising a polynucleotide encoding the fusion protein comprising the N-terminal sequence is enhanced compared to the expression of a corresponding fusion protein from a polynucleotide not comprising the N-terminal XTEN encoding sequence. In such cases, the N-terminal XTEN could either have just the short sequence that enhances expression, or could further include a long XTEN of at least greater than 400 to about 3000 amino acid residues between the N-terminal piece and a binding domain to confer enhanced pharmacokinetic or pharmaceutical properties to the fusion protein, as described above. In one embodiment of the foregoing, the N-terminal XTEN sequence comprises a sequence that exhibits at least about 80% sequence identity, or 81%, 82%, 83%, 84%, 85%, 86%, 87%, 88%, 89%, 90%, 91%, 92%, 93%, 94%, 95%, 96%, 97%, 98%, 99%, or 100% sequence identity to a sequence selected from AE48, AM48, AE624, AE913, and AM923. In another embodiment of the fusion proteins, the linkers, the N-terminal XTEN, as well as the long carrier XTEN can comprise a sequence that can be a fragment of or that exhibits at least about 80% sequence identity, or 81%, 82%, 83%, 84%, 85%, 86%, 87%, 88%, 89%, 90%, 91%, 92%, 93%, 94%, 95%, 96%, 97%, 98%, 99%, or 100% sequence identity to a sequence selected from any one of Tables 4 or 11-15.

The linkers utilized to join the components of the binding fusion proteins should be flexible in nature. In one embodiment the linker joining the $V_L$ and $V_H$ binding domains that form the antigen binding site of the scFv targeting moiety can have from about 15 to about 30 amino acid residues in length. In another embodiment, the linker can have from about 30 to about 200 amino acid residues, or about 40 to about 144 amino acid residues, or about 50 to about 96 amino acid residues. In any of the embodiments hereinabove described in this paragraph, the linker can be a sequence derived from a fragment of any of the XTEN sequences of Tables 4 or 11-15. In another embodiment, the linker can be a sequence in which at least 80% of the residues are comprised of amino acids glycine, serine, and/or glutamate, such as, but not limited to a sequence with about 80-100% sequence identify to the sequence GSGEGSEGEGGGEGSEGEGSGEGGEGEGSG (SEQ ID NO: 1), or a portion or a multimer thereof.

Figure 2A:
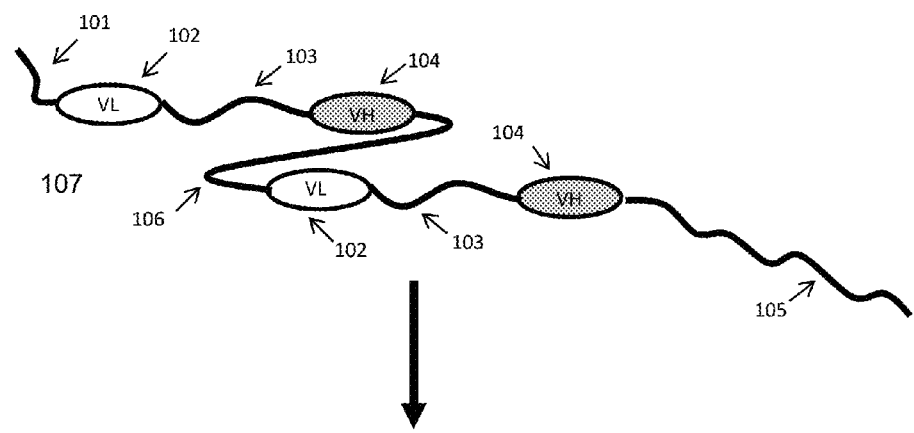
FIG. 2A shows the configuration of a scFv binding fusion protein (107) with two single chain Fv targeting moieties in a "relaxed" conformation, each comprising an N-terminal XTEN sequence (101), a VL binding domain sequence (102), a linker sequence (103), a VH binding domain sequence (104), a second linker sequence joining the first and the second targeting moieties (106) and an XTEN carrier sequence (105) at the C-terminus.
Figure 2B:
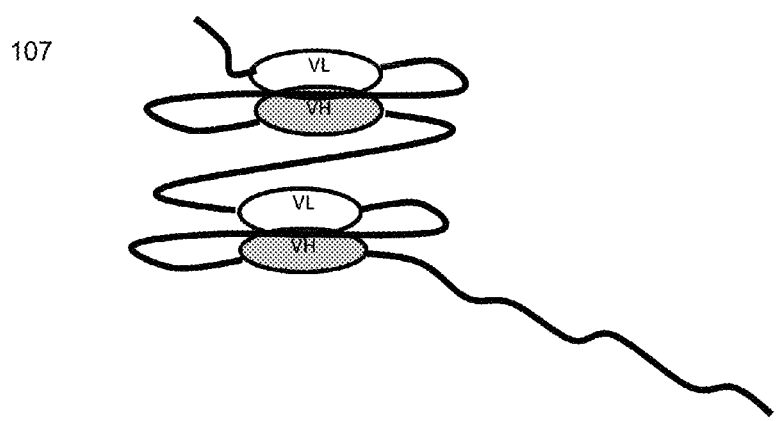
FIG. 2B shows the flexible linkers permitting the two binding domains to come into association to form the antigen binding site of the two respective scFv targeting moieties.

In one embodiment, the invention provides binding fusion proteins comprising two or more scFv targeting moieties (as shown in FIG. 2). In one embodiment, the two or more scFv targeting moieties may be identical. In another embodiment, the two or more scFv targeting moieties may be different and may bind to different targets (e.g., two or more targets of Table 1) or to different epitopes on the same target. In the foregoing embodiments, the two or more scFv targeting moieties can be joined by a linker sequence. The invention contemplates that the linkers as well as the long carrier XTEN and the N-terminal XTEN can comprise a sequence that can be a fragment of or that exhibits at least about 80% sequence identity, or 81%, 82%, 83%, 84%, 85%, 86%, 87%, 88%, 89%, 90%, 91%, 92%, 93%, 94%, 95%, 96%, 97%, 98%, 99%, or 100% sequence identity to a sequence selected from any one of Tables 4 or 11-15.

The invention contemplates various configurations of the multivalent scFv-XTEN binding fusion proteins, with the two or more targeting moieties, linkers and one or more XTEN in various N- to C-terminus configuration; e.g., TM1-L-TM2-XTEN, XTEN-TM1-L-TM2, XTEN-TM1-L-TM2-XTEN, etc.

Figure 9:
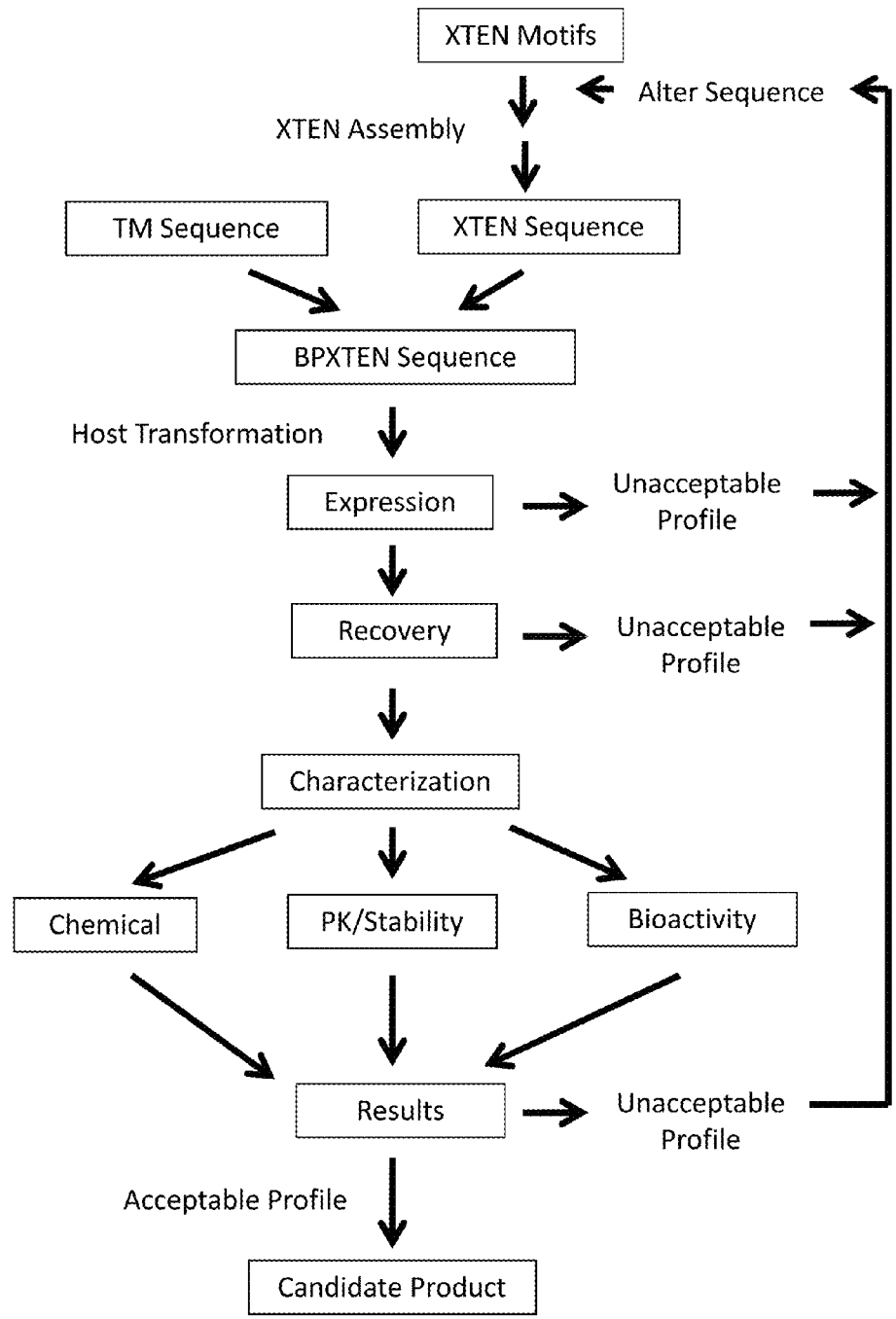
FIG. 9 is a schematic flowchart of representative steps in the assembly of a gene encoding a binding fusion protein comprising a targeting moiety and XTEN, its expression and recovery as a fusion protein, and its evaluation as a candidate binding fusion protein product.
Figure 10A:
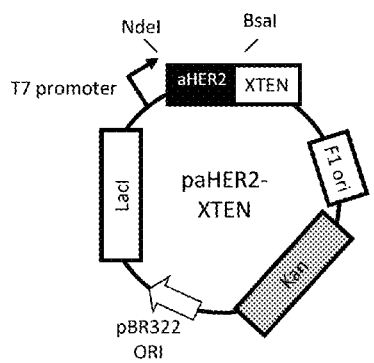
FIG. 10A shows an expression vector encoding XTEN fused to the 3' end of the sequence encoding anti-Her2 binding moiety. Note that no additional leader sequences are required in this vector.
Figure 10B:
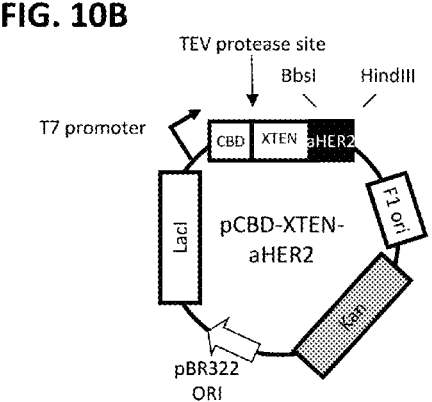
FIG. 10B depicts an expression vector encoding XTEN fused to the 5' end of the sequence encoding anti-Her2 binding moiety with a CBD leader sequence and a TEV protease site.
Figure 10C:
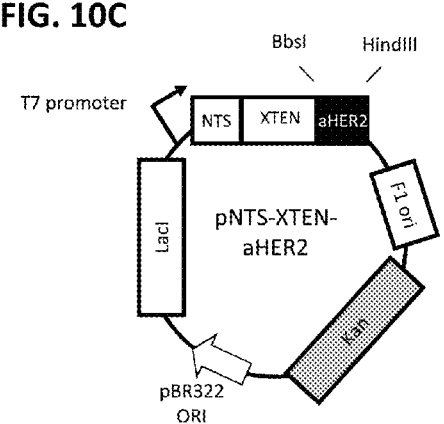
FIG. 10C depicts an expression vector as in FIG. 10B where the CBD and TEV processing site have been replaced with an optimized N-terminal leader sequence (NTS).
Figure 10D:
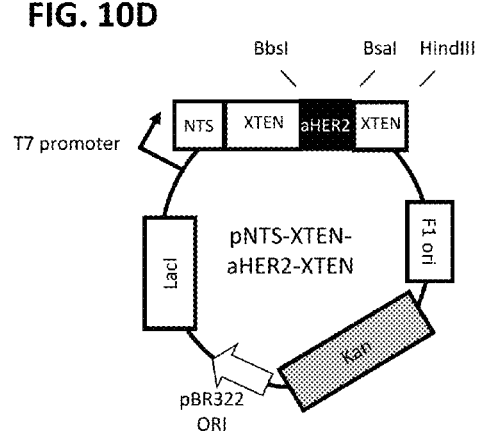
FIG. 10D depicts an expression vector encoding an NTS sequence, an XTEN, a sequence encoding anti-Her2 binding moiety, and then a second sequence encoding an XTEN.

The general methodology for the assembly of the components, the expression and recovery, followed by characterization of the binding fusion protein is illustrated in FIG. 9.

Diabody Binding Fusion Proteins

Figure 3A:
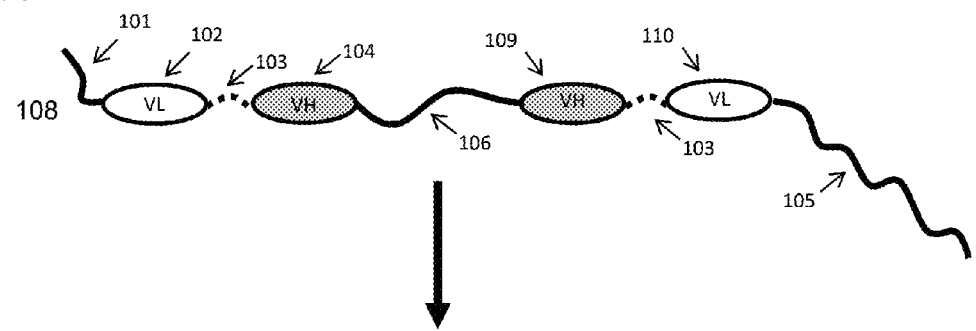
FIG. 3A shows the configuration of a diabody binding fusion protein (108) with the two targeting moieties in a "relaxed" conformation, each comprising an N-terminal XTEN sequence (101), a first VL binding domain sequence (102), a short linker sequence joining the adjacent VL and VH (103), a first VH binding domain sequence (104), a second linker sequence joining the first and the second targeting moieties (106), a second VH binding domain (109) intended to pair with the first VL binding domain (104), a second VL (110) intended to pair with the first VH (104) and an XTEN carrier sequence (105) at the C-terminus.
Figure 3B:
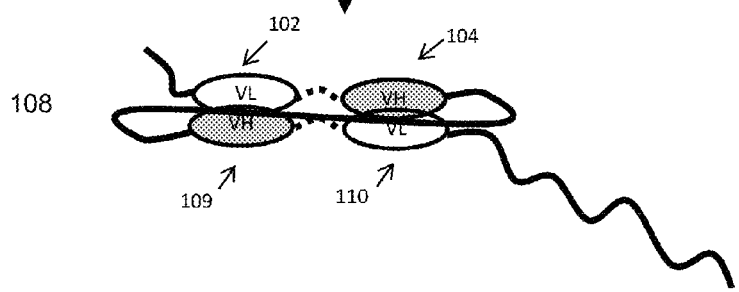
FIG. 3B shows the flexible middle linker permitting two binding domains (VL and VH) from the opposite ends of the molecule (rather than the two adjacent binding domains that are constrained because of the short linker) to come into association to form the two antigen binding sites, resulting in two diabody targeting moieties within the monomeric binding fusion protein.

In another aspect, the invention provides compositions of diabody binding fusion proteins. The term "diabody" or "diabodies", as used herein, refers to fusion proteins comprising antibody fragments with two antigen-binding sites, which fragments comprise a heavy-chain variable domain ($V_H$) connected to a light-chain variable domain ($V_L$) by a short linker in the same polypeptide chain. In one embodiment, the diabody binding fusion protein composition is a single polypeptide chain having two binding moieties, each with $V_L$ and $V_H$ interconnected by a flexible linker of about 30 to about 300 amino acid residues joining the C-terminus of one binding domain pair with the N-terminus of the second binding domain pair, and one or more XTEN on the N- and/or C-terminus (as shown in FIG. 3). In this case, the composition is created by selective incorporation of a linker that is too short to allow pairing between the two adjacent domains, but the targeting moiety regions are connected by longer flexible linker to permit the association between the binding domains from the opposite ends of the fusion protein. For example, it is known that a scFv molecule with a linker 3-12 residues long cannot fold into a functional Fv domain but, generally, instead associates with a second scFv molecule to form a multivalent diabody with two binding sites, while a linker of 1-2 residues tends to favor triabody formation with three binding sites (John L. Atwell et al., Protein Engineering (1999) 12(7):597-604). Thus, in some embodiments, the invention provides diabody binding fusion proteins in which the adjacent binding domain pairs are linked by 1-2 or 3-12 amino acid residues and the binding domain pairs are, in turn, linked by a flexible XTEN linker. In one embodiment of the foregoing, the flexible linker can be an XTEN sequence of about 100 to about 300 amino acid residues. In another embodiment the flexible linker sequence can be comprised of amino acids such as glycine, serine, and/or glutamate making up about 80-100% of the sequence. In another embodiment, the linker can be a sequence in which at least 80% of the residues are comprised of amino acids glycine, serine, and/or glutamate, such as, but not limited to a sequence with about 80-100% sequence identify to the sequence GSGEGSEGEGGGEG-SEGEGSGEGGEGEGSG (SEQ ID NO: 1), or a portion or a multimer thereof.

In one embodiment, the invention provides a diabody binding fusion protein that can be monospecific, binding one type of antigen. In another embodiment, the invention provides a bispecific diabody binding fusion protein in which the targeting moieties are directed to different antigens or different epitopes on the same antigen. In the foregoing embodiments, the specificity of the diabody binding fusion is determined by the incorporation of either identical or different respective $V_H$ and $V_L$ components.

An illustration of one example of a diabody binding fusion proteins is shown in FIG. 2, however the invention contemplates different configurations of the diabody binding fusion proteins; e.g., a different N- to C-terminus order of the $V_H$ and $V_L$ domains, or deleting one of the XTEN sequences from either the N- or C-terminus.

In one embodiment of the foregoing, the composition comprises an XTEN linked to the N-terminus of the diabody binding fusion protein, wherein the expression of the fusion protein in a host cell transformed with a suitable expression vector comprising a polynucleotide encoding the fusion protein comprising the N-terminal sequence is enhanced compared to the expression of a corresponding fusion protein from a polynucleotide not comprising the N-terminal XTEN encoding sequence.

In addition, the invention provides multimers that are trivalent (having three antigen-binding sites), tetravalent (having four antigen-binding sites), and so on. In another embodiment of the diabody fusion proteins, the linkers as well as the long carrier XTEN and the N-terminal XTEN can comprise a sequence that can be a fragment of or that exhibits at least about 80% sequence identity, or 81%, 82%, 83%, 84%, 85%, 86%, 87%, 88%, 89%, 90%, 91%, 92%, 93%, 94%, 95%, 96%, 97%, 98%, 99%, or 100% sequence identity to a sequence selected from any one of Tables 4 or 11-15.

The general methodology for the assembly of the components, the expression and recovery, followed by characterization of the binding fusion protein is illustrated in FIG. 9.

Domain Antibody Binding Fusion Proteins

In another aspect, the invention provides single chain fusion proteins comprising domain antibody targeting moieties linked to XTEN, wherein the fusion protein is able to bind to an antigen or ligand. As used herein, "domain antibody", or "$V_{HH}$," is an immunoglobulin having a variable region ($V_H$) with an antigen-binding site which will alone allows the recognition and complete binding of an antigen, linked to a constant region ($C_H$), but are devoid of the first domain of the constant region ($C_H 1$) and are devoid of a $V_L$ domain. The $V_{HH}$ do not correspond to fragments obtained, for instance, by the degradation of a natural four-chain model immunoglobulin. $V_{HH}$ are devoid of light chains, such that the variable domains of their heavy chains have properties differing from those of the four-chain immunoglobulin variable heavy chain ($V_H$), including no normal interaction sites with the $V_L$ or with the $C_H 1$ domain. $V_{HH}$ can adopt a three-dimensional organization that distinguishes from the conventional three-dimensional organization of four-chain antibodies according to the description that is given by Chothier C. and Lesk A. M, (1987-J. Mol. Biol. 197, 901-917). $V_1$ can comprise type G immunoglobulins, especially of class 2 (IgG2) or class 3 (IgG3). The parental $V_{HH}$ immunoglobulin sequences can be derived from certain animals, especially from members of the camelid family, or from sharks, which can then be generated in host cells by genetic engineering or by chemical synthesis. Appropriate host cells include bacteria (e.g. *E. coli*) and eukaryotic cells, such as yeasts or animal cells including mammalian cells, or plant cells.

In one embodiment, the binding fusion protein can comprise one $V_{HH}$ targeting moiety. In another embodiment, the binding fusion protein can comprise two or more $V_{HH}$ targeting moieties; e.g., two, or three, or four, or five, or six or more $V_{HH}$ targeting moieties. In such case, the linker sequence between the $V_{HH}$ fragments can be, for example, a sequence corresponding to a fragment of the hinge domain of an immunoglobulin (e.g. the long hinge domain) or can be a short XTEN sequence of about 30 to about 300 amino acid residues, or can be a sequence in which at least 80% of the residues are comprised of amino acids glycine, serine, and/or glutamate, such as, but not limited to a sequence with about 80-100% sequence identify to the sequence GSGEGSEG-EGGGEGSEGEGSGEGGEGEGSG (SEQ ID NO: 1), or a portion or a multimer thereof. In one embodiment of the foregoing, the $V_{HH}$ are hetero-specific with binding affinity to different epitopes of the same antigen. In another embodiment, the $V_{HH}$ are hetero-specific with binding affinity to heterologous antigens. The invention contemplates that the $V_{HH}$ binding fusion protein would comprise an additional XTEN sequence of at least greater than about 400 to about 3000 residues in which the XTEN would confer enhanced properties to the composition, as described above. Thus, the invention contemplates binding fusion protein configurations including, but not limited to $V_{HH}$-XTEN; XTEN-$V_{HH}$; $V_{HH}$-Linker-$V_{HH}$-XTEN; XTEN-$V_{HH}$-Linker-$V_{HH}$; and XTEN-$V_{HH}$-Linker-$V_{HH}$-XTEN, or multimers thereof. In the foregoing, for those configurations with two $V_{HH}$, the $V_{HH}$ can be identical or can be different, in the latter case binding two different ligands/antigens or different epitopes on the same ligand/antigen. In an embodiment of the foregoing domain binding fusion protein configurations, the composition comprises an XTEN linked to the N-terminus of the fusion protein, wherein the expression of the fusion protein in a host cell transformed with a suitable expression vector comprising a polynucleotide encoding the fusion protein comprising the N-terminal sequence is enhanced compared to the expression of a corresponding fusion protein from a polynucleotide not comprising the N-terminal XTEN encoding sequence.

In another embodiment of the domain fusion proteins, the linkers as well as the long carrier XTEN and the N-terminal XTEN can comprise a sequence that can be a fragment of or that exhibits at least about 80% sequence identity, or 81%, 82%, 83%, 84%, 85%, 86%, 87%, 88%, 89%, 90%, 91%, 92%, 93%, 94%, 95%, 96%, 97%, 98%, 99%, or 100% sequence identity to a sequence selected from any one of Tables 4 or 11-15. In another embodiment, the linker can be a sequence in which at least 80% of the residues are comprised of amino acids glycine, serine, and/or glutamate, such as, but not limited to a sequence with about 80-100% sequence identify to the sequence GSGEGSEGEGGGEGSEGEGSGEGGEGEGSG (SEQ ID NO: 1), or a portion or a multimer thereof.

The general methodology for the assembly of the components, the expression and recovery, followed by characterization of the binding fusion protein is illustrated in FIG. 9.

Cytokine Binding Fusion Proteins

In another aspect, the invention provides monomeric fusion proteins capable of binding a cytokine to form a non-functional complex, comprising receptor-like binding domains joined by an XTEN, wherein the resulting fusion protein has binding affinity for the target cytokine ligand. As used herein, "cytokines" means a category of soluble, small protein signaling molecules that are used extensively in cellular communication, including but not limited to interleukins, interferons, chemokines, growth factors, colony stimulating factors, tumor necrosis factors, peptide hormones, and other immunomodulating agents that mediate a variety of biological effects, including the regulation of the growth and differentiation of many cell types. The action of cytokines may be autocrine, paracrine, and endocrine. For example, human interleukin-17 is a cytokine which stimulates the expression of interleukin-6, intracellular adhesion molecule 1, interleukin-8, granulocyte macrophage colony-stimulating factor, and prostaglandin E2 expression, and plays a role in the preferential maturation of CD34+ hematopoietic precursors into neutrophils (Yao et al., *J. Immunol.* 155:5483 (1995); Fossiez et al., *J. Exp. Med.* 183:2593 (1996)).

Cytokines are generally bound by cell-surface receptors that, in turn, trigger cascades of intracellular signaling that alter cell functions. These may include upregulation and/or down-regulation of several genes and their transcription products, resulting in the production of other cytokines, an increase in the number of surface receptors for other molecules, or the suppression of their own effect by feedback inhibition. The term "receptor" denotes a cell-associated protein that binds to a bioactive molecule and mediates the effect of the ligand on the cell. "Receptor", as used herein, includes, but is not limited to cytokine receptors and chemokines receptors. While many native cell receptors have binding domains that are immunoglobulin-like, the term "receptor" as used herein specifically excludes immunoglobulins that constitute antibodies or MHC receptors.

Receptors that bind cytokines are typically composed of one or more integral membrane proteins that have an extracellular component that binds the cytokine with high affinity and transduces this binding event to the cell through the transmembrane and cytoplasmic portions of the receptor subunits. The ligand-binding subunit of a receptor is referred to as the alpha chain, while other signal transducing subunits are named beta chains, or gamma chains. Thus, the ability to sequester cytokines, hormones or related ligands prior to binding to their natural cell receptors represents a mechanism to alter the pathogenesis of diseases, disorders or conditions.

Cytokine receptors have been grouped into several families on the basis of similarities in their extracellular ligand binding domains; immunoglobulin superfamily receptor, Class I cytokine receptor family, Class II cytokine receptor family, TNF receptor family, and chemokine receptor family. In some embodiments, the invention provides cytokine binding moieties that comprise binding domains, portions of binding domains, or sequences with sequence identity to members of the foregoing receptor families (except for antibody immunoglobulins specifically excluded above) linked to one or more XTEN sequences, wherein the cytokine binding moiety has at least a portion of the binding affinity compared to the native receptor and, when ligand is sequestered, is able to interfere with the binding of the target ligand to the native receptor. In another embodiment, the invention provides a receptor binding fusion protein that comprise binding domains, portions of binding domains, or sequences with sequence identity to immunoglobulin superfamily receptors linked to one or more XTEN sequences, wherein the binding domains have at least a portion of the binding affinity compared to the native receptor and, when ligand is sequestered, is able to interfere with the binding of the target ligand to the native receptor.

By "cytokine binding moiety" what is meant is at least that minimal portion of the extracellular ligand-binding domain of a cytokine receptor necessary to bind the cytokine. For example, while some cytokine receptors have components designated α and β, one skilled in the art would know which component of the receptor is the signal transducing component and which is the ligand-binding component. Thus to practice the present invention and create a high affinity binding protein for a cytokine, one of skill in the art would create an isolated nucleic acid comprising a nucleotide sequence encoding a first fusion polypeptide component comprising the amino acid sequence of the cytokine binding portion of the extracellular domain of the specificity determining component of the receptor; a nucleotide sequence encoding a second fusion polypeptide component comprising the amino acid sequence of a cytokine binding portion of the extracellular domain that may be the same or may be different from the first, and a nucleotide sequence encoding a third fusion polypeptide component comprising the amino acid sequence of an XTEN linking the binding components to create a gene encoding a high affinity cytokine binding fusion protein for the target cytokine. The general methodology for the assembly of the components, the expression and recovery, followed by characterization of the binding fusion protein is illustrated in FIG. 9.

As used herein, the term "binding domain" may itself include a multi-domain structure wherein two or more individual domains must be closely linked to form a single binding region. Examples of the foregoing are the native receptors to VEGF, fit-1 and flk-1, both of which have seven immunoglobulin-like domains in each of two arms that form the extracellular ligand-binding regions of the receptors (Mathews, et al., PNAS 88:9026 (1991)). However, it has been demonstrated that recombinant proteins comprising either two or three of the seven domains can, when paired with a corresponding second arm comprising either two or three domains, can bind VEGF with high affinity (see U.S. Pat. Nos. 5,952,199, 7,374,757). In some embodiments, VEGF cytokine binding fusion proteins comprise pairs of an Ig domain 2 (D2) and an Ig domain 3 (D3) derived from one or more VEGF receptors, as shown in FIG. 4. In one embodiment of the foregoing, the VEGF receptor is Flt-1. In another embodiment of the foregoing, the VEGF receptor is Flk-1. In yet another embodiment of the foregoing, the VEGF receptor is Flt-4. The domain units may comprise VEGF receptor domains connected directly to each other or, optionally, be connected via spacers or linkers, such as fragments of XTEN.

"Immunoglobulin-like domain" or "Ig-like domain" or "ligand-binding domain" refers to independent and distinct domains that are found in the extracellular ligand-binding region of cytokine receptors and it is specifically intended that the term encompass not only the complete wild-type domain, but also insertional, deletional and substitutional variants thereof that retain at least a portion of the binding affinity of the wild-type domain. It will be readily apparent to those of ordinary skill in the art that numerous variants of the domains or combinations of the domains of the cytokine binding proteins can be obtained which will retain substantially the same functional characteristics as the wild type domain.

The invention also contemplates cytokine binding fusion proteins comprising binding domains derived from multimeric receptors. Multimeric receptors include homodimers (e.g., PDGF receptor αα and ββ isoforms, erythropoietin receptor, MPL, and G-CSF receptor), heterodimers whose subunits each have ligand-binding and effector domains (e.g., PDGF receptor αβ isoform), and multimers having component subunits with disparate functions (e.g., IL-2, IL-3, IL-4, IL-5, IL-6, IL-7, and GM-CSF receptors).

The invention contemplates a number of different constructs employing cytokine binding domains known to have affinity for target ligands of interest. Preferred embodiments of the invention include fusion protein compositions capable of binding a ligand comprising at least a first and a second polypeptide binding domain operatively fused to a linking component, wherein the linking component comprises a flexible XTEN sequence. In one embodiment of the foregoing, the composition further comprises at least a second XTEN as a carrier, wherein the carrier may enhance the pharmacokinetic or pharmaceutical properties of the fusion protein. In another embodiment of the foregoing, the composition comprises an XTEN linked to the N-terminus of the fusion protein, wherein the expression of the fusion protein in a host cell transformed with a suitable expression vector comprising a polynucleotide encoding the fusion protein comprising the N-terminal sequence is enhanced compared to the expression of a corresponding fusion protein from a polynucleotide not comprising the N-terminal XTEN encoding sequence.

In a particular feature of the cytokine binding fusion proteins, the unstructured characteristic of the XTEN linker permits the respective binding domains to adopt a flexible configuration to freely and correctly orient with the ligand for optimal binding. "Flexible configuration", when used in reference to the cytokine binding protein compositions of the present disclosure, means that the receptor polypeptide sequences or domains of the fusion protein are not held in a particular configuration relative to each other but are free to move, under physiologic conditions, to the extent that the XTEN polypeptides tethered to the receptor polypeptides permit. Based upon these characteristics, it is believed that a binding domain of the fusion protein is more likely to encounter and attach to the target ligand, under physiologic conditions, compared to a construct wherein the domains are held in a fixed orientation, such as receptor traps in which the binding domains are fused to and held in place by the dimerization between Fc domains or heavy chains of IgG (see, e.g., U.S. Pat. No. 7,417,134). Not to be bound by a particular theory, upon encountering the target ligand under physiologic or assay conditions, the binding domains of the inventive fusion protein can mutually orientate substantially as in a native cytokine receptor, adopting a constrained configuration to sequester the ligand. "Sequester" or "sequestering" when used in reference to the activity of a cytokine binding fusion protein of the present invention means that the fusion protein binds to the target ligand to form a substantially nonfunctional complex, interfering with its ability to bind to a native receptor. As used herein, "substantially nonfunctional complex" means that the residual activity of the bound ligand and/or its ability to bind to its cognate receptor would be less than about 60%, or less than about 50%, or less than about 40%, or less than about 30%, or less than about 20%, or less than about 10%, or less than about 5%, or less than about 1% compared to un-bound ligand with a native receptor. The cytokine binding fusion proteins are thus antagonists.

Figure 4A:
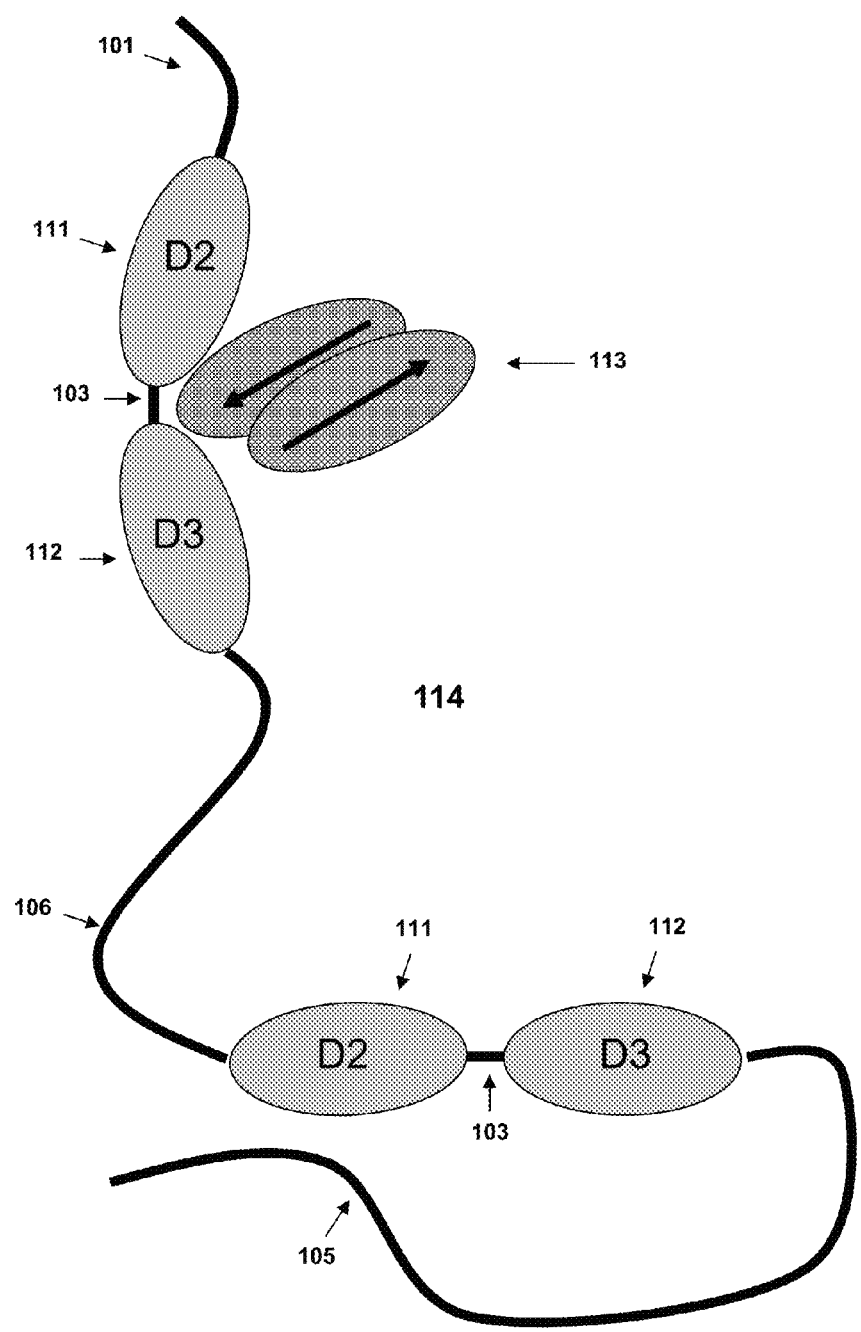
FIG. 4A shows the configuration of the binding fusion protein (114) with the dimer binding regions in a "relaxed" conformation, each comprising an N-terminal XTEN sequence (101), a first D2 domain sequence (111), a short linker sequence joining the adjacent domain units (103), a first D3 domain sequence (112), a second flexible linker sequence joining the first and the second binding domains (106), a second VH binding domain (109) intended to pair with the first VL binding domain (104), a second D2 domain (111), a short linker sequence joining the adjacent domain units (103), a second D3 domain sequence (112), and an XTEN carrier sequence (105) at the C-terminus. In the schematic, the dimeric VEGF target (113) has begun to associate with one of the binding domains.
Figure 4B:
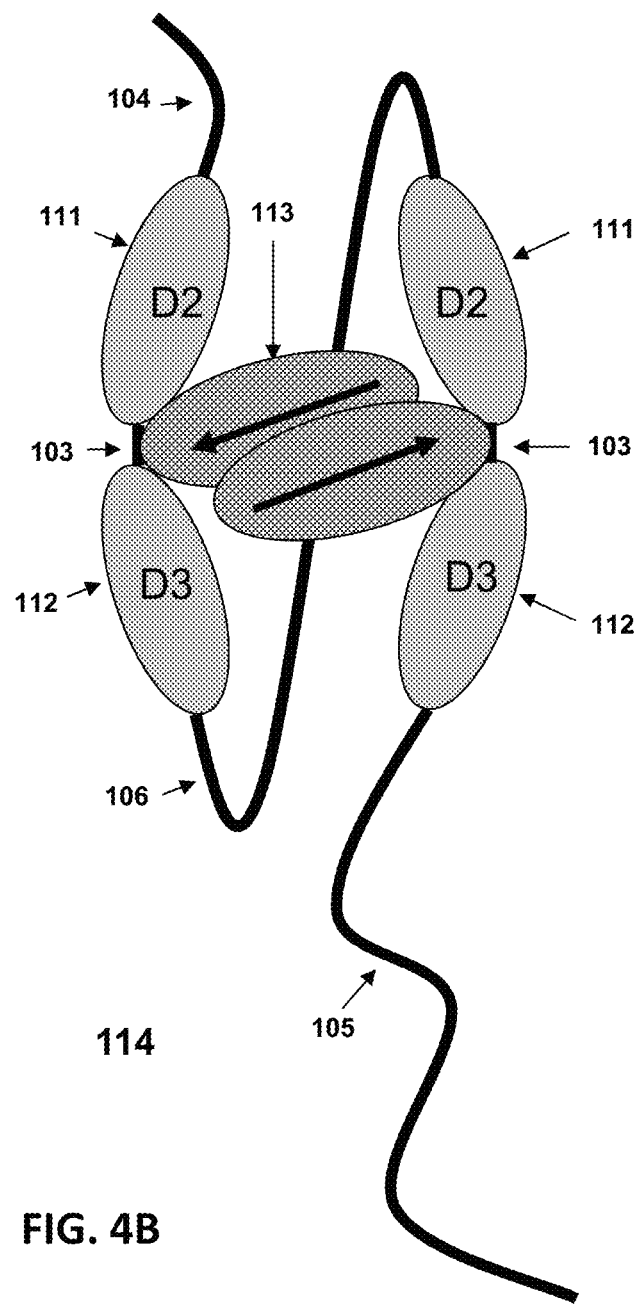
FIG. 4B shows the flexible middle linker permitting two binding domains of the molecule to surround the dimeric VEGF (113) to form the binding complex that sequesters the VEGF molecule.

In light of the foregoing, the binding fusion protein compositions can have an "open" conformation (FIG. 4A) such that, when a target molecule is in close proximity to the binding fusion protein, the interaction with the domains permits a change in conformation wherein both domain units come into association with the target ligand, creating a "closed" conformation (FIG. 4B), effectively sequestering the target molecule.

The fusion proteins of any of the foregoing cytokine binding protein embodiments can further comprise a second and optionally a third XTEN protein, as illustrated in FIG. 4, to impart the enhanced characteristics as a carrier or as a N-terminal XTEN, as described above.

In one embodiment, the cytokine binding proteins are multivalent fusion proteins comprising two binding region domains that are homologous, the XTEN linker, and can further comprise the additional XTEN sequences on the N- and/or C-terminus.

In another embodiment of the cytokine binding fusion proteins, the linkers as well as the long carrier XTEN and the N-terminal XTEN can comprise a sequence that can be a fragment of or that exhibits at least about 80% sequence identity, or 81%, 82%, 83%, 84%, 85%, 86%, 87%, 88%, 89%, 90%, 91%, 92%, 93%, 94%, 95%, 96%, 97%, 98%, 99%, or 100% sequence identity to a sequence selected from any one of Tables 4 or 11-15.

Receptor Binding Fusion Proteins

Figure 5:
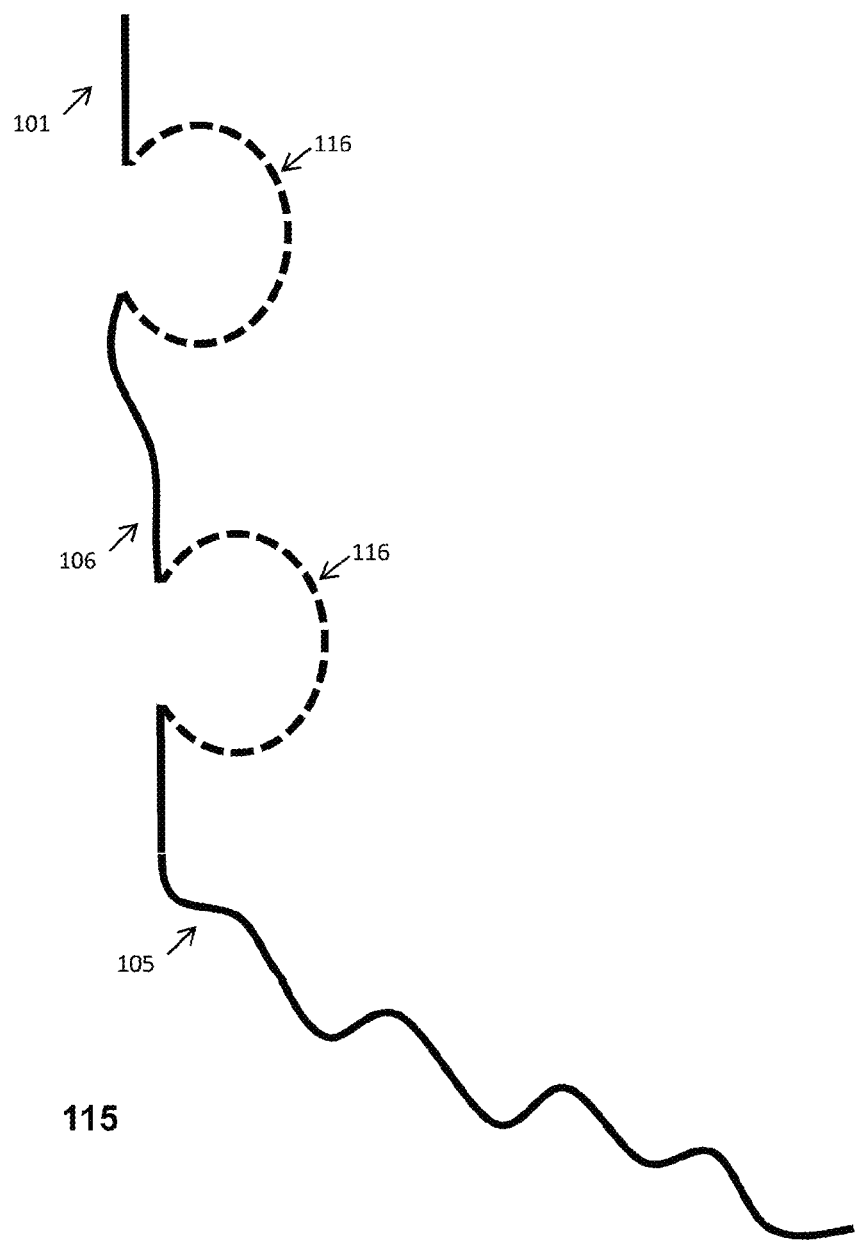
FIG. 5 shows schematic representations of an exemplary receptor binding fusion protein comprising Ig-like binding domains. The binding fusion protein (115) has an N-terminal XTEN sequence (101) and in this case, two Ig-like binding regions (116), a flexible linker sequence joining the adjacent Ig-like binding regions (106) that would permit the two binding regions to sequester the target ligand, and an XTEN carrier sequence (105) at the C-terminus.

In another aspect, the invention provides binding fusion proteins comprised of at least a first binding region comprising a first and optionally a second binding domain derived from Ig-like domains from cell receptors linked to at least a first XTEN. A non-limiting example of the foregoing is a binding protein with Ig-like binding domains derived from the VEGF receptor, with XTEN linked to either the N- or C-terminus of the binding regions, as illustrated in FIGS. 4 and 5. In a particular embodiment of the foregoing, the binding fusion protein can comprise two Ig-like binding regions linked by a short XTEN linker of about 20 to about 200 amino acid residues (e.g., a fragment of an XTEN sequence of Table 4), and a longer XTEN carrier, wherein the VEGF binding regions can bind and substantially sequester dimeric VEGF. In another embodiment, the binding fusion protein can comprise two sets of two Ig-like binding regions, which can be identical or can be different domains, linked by a short XTEN linker of about 20 to about 200 amino acid residues, and one or more longer XTEN carriers, wherein the VEGF binding regions can bind and substantially sequester dimeric VEGF. The receptor binding fusion protein can also comprise a N-terminal XTEN, also illustrated in FIG. 6, wherein the expression of the fusion protein in a host cell transformed with a suitable expression vector comprising a polynucleotide encoding the fusion protein comprising the N-terminal sequence is enhanced compared to the expression of a corresponding fusion protein from a polynucleotide not comprising the N-terminal XTEN encoding sequence. In the foregoing embodiments hereinabove described in this paragraph, the linkers as well as the long carrier XTEN and the N-terminal XTEN can comprise a sequence that can be a fragment of or that exhibits at least about 80% sequence identity, or 81%, 82%, 83%, 84%, 85%, 86%, 87%, 88%, 89%, 90%, 91%, 92%, 93%, 94%, 95%, 96%, 97%, 98%, 99%, or 100% sequence identity to a sequence selected from any one of Tables 4 or 11-15. In another embodiment, the linker can be a sequence in which at least 80% of the residues are comprised of amino acids glycine, serine, and/or glutamate, such as, but not limited to a sequence with about 80-100% sequence identify to the sequence GSGEGSEGEGGGEGSEGEGS-GEGGEGEGSG (SEQ ID NO: 1), or a portion or a multimer thereof.

In a particular feature of the above described embodiments, the cytokine binding fusion proteins can be produced as functionally-active monomers, a characteristic which is believed to require fewer manufacturing steps and result in a more homogenous product compared to constructs requiring a dimerization process (e.g., Fc conjugates) in order to recover a functional molecule.

Bispecific Antibodies

Bispecific antibodies are antibodies that have binding specificities for at least two different epitopes. A non-limiting example of a bispecific binding fusion protein would be one with two targeting moieties that may bind to two different epitopes of the ErbB2 protein. For example, one targeting moiety may bind an epitope in Domain 1 of ErbB2 such as the 7C2/7F3 epitope, the other may bind a different ErbB2 epitope, e.g. the 4D5 epitope. Other such bispecific binding fusion proteins may combine an ErbB2 binding site with binding site(s) for EGFR, ErbB3 and/or ErbB4. Alternatively, an anti-ErbB2 targeting moiety may be combined with a targeting moiety that binds to a triggering molecule on a leukocyte such as a T-cell receptor molecule (e.g. CD2 or CD3), or Fc receptors for IgG (FcγR), such as FcγRI (CD64), FcγRII (CD32) and FcγRIII (CD16) so as to focus cellular defense mechanisms to the ErbB2-expressing cell. Bispecific binding fusion proteins can be prepared with targeting moieties that are multivalent scFv, multivalent domain antibodies, or diabodies.

(d) Configurations of Binding Fusion Proteins

The invention contemplates different configurations of binding fusion proteins, including but not limited to those comprising targeting moieties characterized as scFv, diabodies, domain antibodies, bifunctional antibodies or cytokine binding fusion proteins, linked to one or more XTEN, and optionally having one or more linkers. For binding fusion proteins with a single targeting moiety, the invention provides a monomeric binding fusion protein of formula I:

$$(XTEN)_x\text{-TM-}(XTEN)_y \qquad \text{I}$$

wherein independently for each occurrence: XTEN is an extended recombinant polypeptide as described above, x is either 0 or 1; y is either 0 or 1, wherein x+y≥1; and TM is a targeting moiety with binding affinity to a target, preferably a target selected from Table 1 or Table 2. In one embodiment, the TM comprises two or more binding domains that may be joined by a linker sequence of 1 to about 300 amino acid residues having a flexible, unstructured conformation. In one embodiment, the linker sequence is an XTEN having at least about 12 to about 300 amino acids exhibiting a flexible, unstructured characteristic, such as a fragment of an XTEN, such that the binding domains can thereby mutually orientate relative to each other and the ligand and adopt a constrained configuration to bind the target ligand. In another embodiment, the linker can be a sequence in which at least 80% of the residues are comprised of amino acids glycine, serine, and/or glutamate, such as, but not limited to a sequence with about 80-100% sequence identify to the sequence GSGEGSEG-EGGGEGSEGEGSGEGGEGEGSG (SEQ ID NO: 1), or a portion or a multimer thereof. In another embodiment, wherein the TM comprises two or more binding domains, the binding domains may be identical or they may be different, and can comprise, for example, sequences derived from such $V_L$ or $V_H$ sequences, receptor binding domains, or Ig-like binding domains as necessary to bind with sufficient affinity to the target ligand.

In another embodiment, the invention provides a multivalent binding fusion protein with two binding moieties of formula II:

$$(XTEN)_x\text{-TM1-L-TM2-}(XTEN)_y \qquad \text{II}$$

wherein independently for each occurrence: XTEN is an extended recombinant polypeptide as described above, x is either 0 or 1; y is either 0 or 1, wherein x+y≥1; TM1 is a targeting moiety with binding affinity to a target, preferably a target selected from Table 1 or Table 2; TM2 is a targeting moiety with binding affinity to the target ligand that may be identical or may be different to TM1; and L is a linker sequence having between 1 to about 300 amino acid residues wherein the linker sequence is covalently bound to the C terminus of TM1 and the N terminus of TM2. In one embodiment, the respective TM may each comprise two or more binding domains that may be joined by an additional linker sequence of 1 to about 300 amino acid residues having a flexible, unstructured conformation. In one embodiment, the linker sequence is an XTEN or a fragment of an XTEN from any one of Tables 4 or 11-15 having at least about 12 to about 300 amino acids exhibiting a flexible, unstructured characteristic such that the binding domains can thereby mutually orientate relative to each other and the ligand and adopt a constrained configuration to bind to the target ligand. In another embodiment, the linker can be a sequence in which at least 80% of the residues are comprised of amino acids glycine, serine, and/or glutamate, such as, but not limited to a sequence with about 80-100% sequence identify to the sequence GSGEGSEGEGGGEGSEGEGSGEGGEGEGSG (SEQ ID NO: 1), or a portion or a multimer thereof. In another embodiment, wherein the TM comprises two or more binding domains, the binding domains may be identical or they may be different, and can comprise, for example, sequences derived from such $V_L$ or $V_H$ sequences, receptor binding domains, or Ig-like binding domains as necessary to bind with sufficient affinity to the target ligand.

In another embodiment, the invention provides a multivalent binding fusion protein with two binding moieties of formula III:

$$\text{TM1-XTEN-TM2} \qquad \text{III}$$

wherein independently for each occurrence: XTEN is an extended recombinant polypeptide as described above; TM1 is a targeting moiety with binding affinity to a target, preferably a target selected from Table 1 or Table 2; and TM2 is a targeting moiety with binding affinity to a target, preferably a target selected from Table 1 or Table 2 that may be identical or may be different to TM1. In one embodiment, the respective TM may each comprise two or more binding domains that may be joined by an additional linker sequence of 1 to about 300 amino acid residues having a flexible, unstructured conformation. In one embodiment, the linker sequence is an XTEN or a fragment of an XTEN from any one of Tables 4 or 11-15 having at least about 12 to about 300 amino acids exhibiting a flexible, unstructured characteristic such that the binding domains can thereby mutually orientate relative to each other and the ligand and adopt a constrained configuration to bind to the target ligand. In another embodiment, the linker can be a sequence in which at least 80% of the residues are comprised of amino acids glycine, serine, and/or glutamate, such as, but not limited to a sequence with about 80-100% sequence identify to the sequence GSGEGSEG-EGGGEGSEGEGSGEGGEGEGSG (SEQ ID NO: 1), or a portion or a multimer thereof. In another embodiment, wherein the TM comprises two or more binding domains, the binding domains may be identical or they may be different, and can comprise, for example, sequences derived from such $V_L$ or $V_H$ sequences, receptor binding domains, or Ig-like binding domains as necessary to bind with sufficient affinity to the target ligand.

In another embodiment, the invention provides a multivalent binding fusion protein with three binding moieties of formula IV:

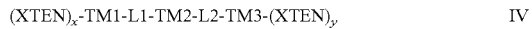

$$(XTEN)_x\text{-TM1-L1-TM2-L2-TM3-}(XTEN)_y, \quad \text{IV}$$

wherein independently for each occurrence: XTEN is an extended recombinant polypeptide as described above, x is either 0 or 1; y is either 0 or 1, wherein x+y≥1; TM1 is a targeting moiety with binding affinity to a target, preferably a target selected from Table 1 or Table 2; TM2 is a targeting moiety with binding affinity to a target, preferably a target selected from Table 1 or Table 2 that may be identical or may be different to TM1; TM3 is a targeting moiety with binding affinity to a target, preferably a target selected from Table 1 or Table 2 that may be identical or may be different to either TM1 or TM2; L1 is a linker sequence having between 1 to about 300 amino acid residues as described for formula II, and wherein the linker sequence is covalently bound to the C terminus of TM1 and the N terminus of TM2; and L2 is a linker sequence that may be identical to or different from L1, having between 1 to about 300 amino acid residues as described as for formula II, and wherein the linker sequence is covalently bound to the C terminus of TM2 and the N terminus of TM3. In one embodiment, the respective TM may each comprise two or more binding domains that may be joined by an additional linker sequence of 1 to about 300 amino acid residues having a flexible, unstructured conformation. In one embodiment, the linker sequence is an XTEN having at least about 12 to about 300 amino acids exhibiting a flexible, unstructured characteristic such that the binding domains can thereby mutually orientate relative to each other and the ligand and adopt a constrained configuration to bind to the target ligand. In another embodiment, wherein the TM comprises two or more binding domains, the binding domains may be identical or they may be different, and can comprise, for example, sequences derived from such $V_L$ or $V_H$ sequences, receptor binding domains, or Ig-like binding domains as necessary to bind with sufficient affinity to the target ligand.

The invention contemplates additional and alternative configurations of the foregoing embodiments, including additional targeting moieties, binding regions, linkers and XTEN configured in alternative permutations of order, N- to C-terminus, for the various components. The binding fusion proteins of the embodiments disclosed herein exhibit one or more or any combination of the properties and/or the embodiments as detailed herein.

(e) Configurations of Binding Fusion Proteins with Spacer and Cleavage Sequences The invention contemplates configurations of binding fusion proteins, including but not limited to those comprising targeting moieties characterized as scFv, diabodies, domain antibodies, bifunctional antibodies or cytokine binding fusion proteins, in which the XTEN may be linked to targeting moieties by spacer sequences incorporated into or adjacent to the XTEN that are designed to incorporate or enhance a functionality or property to the composition, or as an aid in the assembly or manufacture of the binding fusion protein compositions. Such properties include, but are not limited to, inclusion of cleavage sequence(s) to permit release of components, inclusion of amino acids compatible with nucleotide restrictions sites to permit linkage of XTEN-encoding nucleotides to targeting moiety-encoding nucleotides or that facilitate construction of expression vectors, or to reduce steric hindrance in regions of the fusion proteins.

A spacer sequence can be introduced between an XTEN sequence and a targeting moiety component to decrease steric hindrance such that the targeting moiety component may assume its desired tertiary structure and/or interact appropriately with its target. For spacers and methods of identifying desirable spacers, see, for example, George, et al. (2003) Protein Engineering 15:871-879, specifically incorporated by reference herein. In one embodiment, the spacer comprises one or more peptide sequences that are between 1-50 amino acid residues in length, or about 1-25 residues, or about 1-10 residues in length. Spacer sequences, exclusive of cleavage sites, can comprise any of the 20 natural L amino acids, and will preferably have XTEN-like properties in that 1) they will comprise hydrophilic amino acids that are sterically unhindered such as, but not limited to, glycine (G), alanine (A), serine (S), threonine (T), glutamate (E), proline (P) and aspartate (D); and 2) will be substantially non-repetitive. In some cases, the spacer can be polyglycines or polyalanines, or is predominately a mixture of combinations of glycine, serine and alanine residues. In one embodiment, a spacer sequence, exclusive of cleavage site amino acids, has about 1 to 10 amino acids that consist of amino acids selected from glycine (G), alanine (A), serine (S), threonine (T), glutamate (E), and proline (P) and are substantially devoid of secondary structure; e.g., less than about 10%, or less than about 5% as determined by the Chou-Fasman and/or GOR algorithms. In one embodiment, the spacer sequence is GPEGPS (SEQ ID NO: 145). In another embodiment, the spacer sequence is GPEGPS (SEQ ID NO: 145) linked to a cleavage sequence of Table 7. In addition, spacer sequences are designed to avoid the introduction of T-cell epitopes; determination of which are described above and in the Examples.

In one embodiment, the binding fusion protein comprises one or more spacer sequences linked at the junction(s) between the payload sequence and the one more XTEN incorporated into the fusion protein, wherein the spacer sequences comprise amino acids that are compatible with nucleotides encoding restriction sites. In another embodiment, the binding fusion protein comprises one or more spacer sequences linked at the junction(s) between the payload sequence and the one more XTEN incorporated into the fusion protein wherein the spacer sequences comprise amino acids that are compatible with nucleotides encoding restriction sites and the amino acids and the one more spacer sequence amino acids are chosen from glycine (G), alanine (A), serine (S), threonine (T), glutamate (E), and proline (P). In another embodiment, the binding fusion protein comprises one or more spacer sequences linked at the junction(s) between the payload sequence and the one more XTEN incorporated into the fusion protein wherein the spacer sequences comprise amino acids that are compatible with nucleotides encoding restriction sites and the one more spacer sequences are chosen from the sequences of Table 6. The exact sequence of each spacer sequence is chosen to be compatible with cloning sites in expression vectors that are used for a particular binding fusion protein construct. For embodiments in which a single XTEN is attached to the N- or C-terminus, only a single spacer sequence at the junction of the two components would be required. As would be apparent to one of ordinary skill in the art, the spacer sequences comprising amino acids compatible with restriction sites could be omitted from the construct when an entire fusion protein gene is synthetically generated, rather than ligated using targeting moiety and XTEN encoding genes.

TABLE 6

Spacer Sequences Compatible with Restriction Sites

| Spacer Sequence | Restriction Enzyme |
|---|---|
| GSPG (SEQ ID NO: 146) | BsaI |
| ETET (SEQ ID NO: 147) | BsaI |
| PGSSS (SEQ ID NO: 148) | BbsI |
| GAP | AscI |
| GPA | FseI |
| GPSGP (SEQ ID NO: 149) | SfiI |
| AAA | SacII |
| TG | AgeI |
| GT | KpnI |

In some embodiments, a spacer sequence in a binding fusion protein composition comprises one or more cleavage sequences, which are identical or different, wherein the cleavage sequence may be acted on by a protease to release the XTEN sequence(s) from the fusion protein. In one embodiment, the incorporation of the cleavage sequence into the binding fusion protein is designed to permit release of an targeting moiety that becomes active or more active upon its release from the XTEN component. The cleavage sequences are located sufficiently close to the targeting moiety sequences, generally within 18, or within 12, or within 6, or within 2 amino acids of the targeting moiety sequence, such that any remaining residues attached to the targeting moiety after cleavage do not appreciably interfere with the activity (e.g., such as binding to a target), yet provide sufficient access to the protease to be able to effect cleavage of the cleavage sequence. In some cases, the binding fusion protein comprising the cleavage sequences will also have one or more spacer sequence amino acids between the targeting moiety and the cleavage sequence or the XTEN and the cleavage sequence to facilitate access of the protease to the cleavage sequence; the spacer amino acids comprising any natural amino acid, including glycine, serine and alanine as preferred amino acids. In one embodiment, the cleavage site is a sequence that can be cleaved by a protease endogenous to the mammalian subject such that the fusion protein can be cleaved after administration to a subject. In one embodiment of the foregoing construct, the targeting moiety that is released from the fusion protein by cleavage of the cleavage sequence exhibits at least about a two-fold, or at least about a three-fold, or at least about a four-fold, or at least about a five-fold, or at least about a six-fold, or at least about a eight-fold, or at least about a ten-fold, or at least about a 20-fold increase in activity compared to the intact binding fusion protein.

Examples of cleavage sites contemplated by the invention include, but are not limited to, a polypeptide sequence cleavable by a mammalian endogenous protease selected from FXIa, FXIIa, kallikrein, FVIIIa, FVIIIa, FXa, FIIa (thrombin), Elastase-2, granzyme B, MMP-12, MMP-13, MMP-17 or MMP-20, or by non-mammalian proteases such as TEV, enterokinase, PreScission™ protease (rhinovirus 3C protease), and sortase A. Sequences known to be cleaved by the foregoing proteases and others are known in the art. Exemplary cleavage sequences contemplated by the invention and the respective cut sites within the sequences are presented in Table 7, as well as sequence variants thereof.

In one embodiment, the invention provides binding fusion proteins comprising one or more cleavage sequences operably positioned to release the targeting moiety from the fusion protein upon cleavage, wherein the one or more cleavage sequences has at least about 86%, or at least about 92% or greater sequence identity to a sequence selected from Table 7.

In some embodiments, only the two or three amino acids flanking both sides of the cut site (four to six amino acids total) are incorporated into the cleavage sequence that, in turn, is incorporated into the fusion proteins of the embodiments. In other embodiments, the incorporated cleavage sequence of Table 7 can have one or more deletions or insertions or one or two or three amino acid substitutions for any one or two or three amino acids in the known sequence, wherein the deletions, insertions or substitutions result in reduced or enhanced susceptibility but not an absence of susceptibility to the protease, resulting in an ability to tailor the rate of release of the targeting moiety from the XTEN. Exemplary substitutions are shown in Table 7.

TABLE 7

Protease Cleavage Sequences

| Protease Acting Upon Sequence | Exemplary Cleavage Sequence | SEQ ID NO: | Minimal Cut Site* | SEQ ID NO: |
|---|---|---|---|---|
| FXIa | KLTR↓AET | 150 | KD/FL/T/R↓VA/VE/GT/GV | |
| FXIa | DFTR↓VVG | 151 | KD/FL/T/R↓VA/VE/GT/GV | |
| FXIIa | TMTR↓IVGG | 152 | NA | |
| Kallikrein | SPFR↓STGG | 153 | —/—/FL/RY↓SR/RT/—/— | |
| FVIIa | LQVR↓IVGG | 154 | NA | |
| FIXa | PLGR↓IVGG | 155 | —/—/G/R↓—/—/—/— | |
| FXa | IEGR↓TVGG | 156 | IA/E/GFP/R↓STI/VFS/—/G | |
| FIIa (thrombin) | LTPR↓SLLV | 157 | —/—/PLA/R↓SAG/—/—/— | |
| Elastase-2 | LGPV↓SGVP | 158 | —/—/—/VIAT↓—/—/—/— | |

TABLE 7-continued

Protease Cleavage Sequences

| Protease Acting Upon Sequence | Exemplary Cleavage Sequence | SEQ ID NO: | Minimal Cut Site* | SEQ ID NO: |
|---|---|---|---|---|
| Granzyme-B | VAGD↓SLEE | 159 | V/-/-/D↓/-/-/- | |
| MMP-12 | GPAG↓LGGA | 160 | G/PA/-/G↓L/-/G/- | 161 |
| MMP-13 | GPAG↓LRGA | 162 | G/P/-/G↓L/-/GA/- | 163 |
| MMP-17 | APLG↓LRLR | 164 | -/PS/-/-↓LQ/-/LT/- | |
| MMP-20 | PALP↓LVAQ | 165 | NA | |
| TEV | ENLYFQ↓G | 166 | ENLYFQ↓G/S | 167 |
| Enterokinase | DDDK↓IVGG | 168 | DDDK↓IVGG | 169 |
| Protease 3C (PreScission ™) | LEVLFQ↓GP | 170 | LEVLFQ↓GP | 171 |
| Sortase A | LPKT↓GSES | 172 | L/P/KEAD/T↓G/-/EKS/S | 173 |

↓ indicates cleavage site
NA: not applicable
*the listing of multiple amino acids before, between, or after a slash indicate alternative amino acids that can be substituted at the position; "—" indicates that any amino acid may be substituted for the corresponding amino acid indicated in the middle column (f) Methods of Use of Binding Fusion Proteins In another aspect, the invention provides a method of for achieving a beneficial effect in a disease, disorder or condition mediated by a binding fusion protein. In one embodiment, the invention provides the use of a binding fusion protein derived from a parental antibody that binds to a target selected from the group consisting of the targets of Table 1 in treatment of a disease, disorder or condition to a subject in need thereof by the administration of a therapeutically effective amount of the binding fusion protein, wherein said administration leads to the eradication or amelioration of one or more of the physiological or clinical symptoms associated with the underlying disorder such that an improvement is observed in the subject, notwithstanding that the subject may still be afflicted with the underlying disorder. In another embodiment, the invention provides a method of treating a disease, disorder, or condition in a mammal comprising administering to the mammal a therapeutically effective amount of a binding fusion protein comprising one or more targeting moieties directed to one or more targets selected from Table 1, linked to one or more XTEN sequences molecules and, optionally, one or more linkers, to form the binding fusion protein, wherein the linkage does not substantially alter the essential functional properties of the binding fusion protein of binding affinity and sustained terminal half-life or reduced serum clearance rate as compared to that of the parental targeting moiety from which the binding fusion protein is derived, and wherein the administration of the binding fusion protein achieves a beneficial therapeutic effect. The effective amount can produce a beneficial effect in helping to treat (e.g., cure or reduce the severity) or prevent (e.g., reduce the likelihood of onset or severity) a disease, disorder or condition, such as, but not limited to a cancer, a cardiovascular disease or condition, an infectious disease, an inflammatory condition, a respiratory condition, organ transplant rejection, or a metabolic disease mediated by or associated with one or more targets, preferably selected from Table 1.

In one embodiment, the method comprises administering a therapeutically-effective amount of a pharmaceutical composition comprising a binding fusion protein composition comprising one or more targeting moieties linked to one or more XTEN sequence(s) and at least one pharmaceutically acceptable carrier to a subject in need thereof that results in an improvement in at least one parameter, physiologic condition, or clinical outcome mediated by the targeting moiety component(s). The method contemplates administration of the pharmaceutical composition by any route appropriate for the disease, disorder or condition being treated, including subcutaneously, intramuscularly, intravitreally, or intravenously.

The methods of the invention include administration of consecutive doses of a therapeutically effective amount of the pharmaceutical composition for a period of time sufficient to achieve and/or maintain the desired parameter or clinical effect, and such consecutive doses of a therapeutically effective amount establishes the therapeutically effective dose regimen for the pharmaceutical composition; i.e., the schedule for consecutively administered doses, wherein the doses are given in therapeutically effective amounts to result in a sustained beneficial effect on any clinical sign or symptom, aspect, measured parameter or characteristic of a metabolic disease state or condition, including, but not limited to, those described herein.

A therapeutically effective amount of the pharmaceutical composition may vary according to factors such as the disease state, age, sex, and weight of the individual, and the ability of the antibody or antibody portion to elicit a desired response in the individual. A therapeutically effective amount is also one in which any toxic or detrimental effects of the binding fusion protein are outweighed by the therapeutically beneficial effects. A prophylactically effective amount refers to an amount of pharmaceutical composition required for the period of time necessary to achieve the desired prophylactic result.

For the inventive methods, longer acting binding fusion protein compositions or pharmaceutical compositions are preferred, so as to improve patient convenience, to increase the interval between doses and to reduce the amount of drug required to achieve a sustained effect. In one embodiment, a method of treatment comprises administration of a therapeutically effective dose of a binding fusion protein to a subject in need thereof that results in a gain in time spent within a therapeutic window established for the fusion protein of the pharmaceutical composition compared to the corresponding targeting moiety component(s) not linked to the XTEN and administered at a comparable dose to a subject. In one embodiment, the gain in time spent within the therapeutic window is at least about three-fold, or at least about four-fold, or at least about five-fold, or at least about six-fold, or at least about eight-fold, or at least about 10-fold, or at least about 20-fold, or at least about 40-fold compared to the corresponding targeting moiety component not linked to the XTEN and administered at a comparable dose to a subject. The methods further provide that administration of multiple consecutive doses of a pharmaceutical composition administered using a therapeutically effective dose regimen to a subject in need thereof can result in a gain in time between consecutive $C_{max}$ peaks and/or $C_{min}$ troughs for blood levels of the binding fusion protein compared to the corresponding targeting moieties not linked to the XTEN. In the foregoing embodiment, the gain in time spent between consecutive $C_{max}$ peaks and/or $C_{min}$ troughs can be at least about three-fold, or at least about four-fold, or at least about five-fold, or at least about six-fold, or at least about eight-fold, or at least about 10-fold, or at least about 20-fold, or at least about 40-fold compared to the corresponding targeting moiety component(s) not linked to the XTEN and administered using a comparable dose regimen established for that targeting moiety. In the embodiments hereinabove described in this paragraph the administration of the fusion protein or pharmaceutical composition can result in an improvement in at least one parameter known to be useful for assessing the subject diseases, conditions or disorders) using a lower unit dose in moles of fusion protein compared to the corresponding targeting moiety component(s) not linked to the XTEN and administered at a comparable unit dose or dose regimen to a subject.

In one embodiment, the administration of a binding fusion protein or pharmaceutical composition can result in an improvement in one of the clinical, biochemical or physiologic parameters that is greater than that achieved by administration of the targeting moiety component not linked to XTEN, determined using the same assay or based on a measured clinical parameter. In another embodiment, administration of the binding fusion protein or pharmaceutical composition can result in improvement two or more clinical or metabolic-related parameters, each mediated by one of the different targeting moieties that collectively result in an enhanced effect compared the targeting moiety component not linked to the XTEN, determined using the same assays or based on measured clinical parameters. In another embodiment, administration of the binding fusion protein or pharmaceutical composition can result in activity in one or more of the clinical or biochemical or physiologic parameters that is of longer duration than the activity of one of the single targeting moiety components not linked to the XTEN, determined using that same assay or based on a measured clinical parameter.

In one embodiment, the binding fusion protein is used to treat VEGF-mediated disorders. In particular, the invention provides a method for treating a VEGF-mediated disease in a human patient with a binding fusion protein comprising one or more of the targeting moieties that binds to human VEGF, wherein the binding reduces the ability of the VEGF to bind its cognate receptor. Such binding fusion proteins can have prophylactic and therapeutic applications in a broad spectrum of VEGF-mediated disorders, including pathologies supported by blood vessel proliferation, i.e. angiogenesis, in a manner similar to the application of anti-VEGF antibodies in the treatment of such disease indications that is known in the art, which treatment indications include solid tumors ((Kim et al. *Nature* 362:841-844 (1993); Warren et al. *J. Clin. Invest.* 95:1789-1797 (1995); Borgström et al. *Cancer Res.* 56:4032-4039 (1996); and Melnyk et al. *Cancer Res.* 56:921-924 (1996)) and intraocular neovascular syndromes such as proliferative retinopathies and age-related macular degeneration (AMD) (Adamis et al. *Arch. Ophthalmol.* 114:66-71 (1996)).

Fusion proteins comprising the XTEN of the invention can approximate the in vivo pharmacokinetics (e.g. terminal half-life) of full-length antibody. Given these characteristics, it is believed that the binding fusion proteins of the invention comprising anti-VEGF targeting moieties display the same or substantially similar in vivo activities as full length anti-VEGF monoclonal antibody across a range of different parameters, including pharmacokinetic characteristics and therapeutic endpoints in an animal tumor model, supporting the utility of the binding fusion proteins in the same broad spectrum of neovascular disease indications that responds to full length anti-VEGF antibody treatment.

Any binding fusion protein disclosed herein that comprises a targeting moiety derived from an anti-VEGF antibody or fragment can be advantageously utilized in a method of treating a VEGF-mediated disease or disorder, such as neovascular disorders. In one embodiment, the invention provides a method of treating a neovascular disorder in a human patient comprising administering to the patient a therapeutically effective amount of a binding fusion protein or pharmaceutical composition wherein at least one targeting moiety in the binding fusion protein comprises an antigen binding site that binds to human VEGF.

In another embodiment, the invention provides a method of treating a solid tumor disorder in a human patient comprising administering to the patient an effective amount of a binding fusion protein or pharmaceutical composition wherein at least one targeting moiety in the binding fusion protein comprises an antigen binding site that binds to human VEGF. In yet another embodiment, the solid tumor disorder in the foregoing method is selected from the group consisting of breast carcinomas, lung carcinomas, gastric carcinomas, esophageal carcinomas, colorectal carcinomas, liver carcinomas, ovarian carcinomas, thecomas, arrhenoblastomas, cervical carcinomas, endometrial carcinoma, endometrial hyperplasia, endometriosis, fibrosarcomas, choriocarcinoma, head and neck cancer, nasopharyngeal carcinoma, laryngeal carcinomas, hepatoblastoma, Kaposi's sarcoma, melanoma, skin carcinomas, hemangioma, cavernous hemangioma, hemangioblastoma, pancreas carcinomas, retinoblastoma, astrocytoma, glioblastoma, Schwannoma, oligodendroglioma, medulloblastoma, neuroblastomas, rhabdomyosarcoma, osteogenic sarcoma, leiomyosarcomas, urinary tract carcinomas, thyroid carcinomas, Wilm's tumor, renal cell carcinoma, prostate carcinoma, abnormal vascular proliferation associated with phakomatoses, edema (such as that associated with brain tumors), and Meigs' syndrome.

In still another embodiment, the invention provides a method of treating an intraocular neovascular disorder in a human patient comprising administering to the patient a therapeutically effective amount of a binding fusion protein or pharmaceutical composition wherein at least one targeting moiety comprises an antigen binding site that binds to human VEGF. In a further embodiment, the intraocular neovascular disorder is selected from the group consisting of diabetic and other proliferative retinopathies including retinopathy of prematurity, retrolental fibroplasia, neovascular glaucoma, and age-related macular degeneration.

In another embodiment, the invention provides a method of inhibiting angiogenesis in a human patient comprising administering to the patient an effective amount of a binding fusion protein wherein at least one targeting moiety in the composition comprises an antigen binding site that binds to human VEGF.

In another embodiment, the binding fusion protein is used to treat disorders mediated by HER2-expressing cells. The invention provides a method for treating a human disease mediated by HER2-expressing cells with a binding fusion protein composition that is derived from a parental antibody that binds to HER2. Such compositions have prophylactic and therapeutic applications in a broad spectrum of HER2-expressing cell-mediated disorders, including pathologies supported by the proliferation of cells expressing HER2, such as cancers characterized by over-expression of HER2, in a manner similar to the application of full length anti-Her2 antibodies in the treatment of such disease indications that is known in the art, which treatment indications include HER2-overexpressing breast, ovarian and lung cancers. The choice of a targeting moiety for a binding fusion protein to be used in the method can be determined by in vitro binding assays or in vitro cell-killing assays as described in the Examples or are known in the art. For example, a candidate binding fusion protein against HER2 can be used in cytotoxicity tests using cell cultures of human breast cancer lines such as MCF-7, CAMA-1, SKBR-3, and BT-20, such as described in U.S. Pat. No. 4,753,894. In one embodiment, the invention provides a method of treating a HER2-expressing cell mediated disorder in a human patient comprising administering to the patient a therapeutically effective amount of a binding fusion protein or pharmaceutical composition wherein at least one targeting moiety in the binding fusion protein comprises an antigen binding site that binds to HER2. The disorder can be a HER2-expressing cell proliferative disorder, including a benign or malignant tumor characterized by the over-expression of the ErbB2 receptor, e.g. a cancer, such as, breast cancer, squamous cell cancer, small-cell lung cancer, non-small cell lung cancer, gastrointestinal cancer, pancreatic cancer, glioblastoma, cervical cancer, ovarian cancer, liver cancer, bladder cancer, hepatoma, colon cancer, colorectal cancer, endometrial carcinoma, salivary gland carcinoma, kidney cancer, liver cancer, prostate cancer, vulval cancer, thyroid cancer, hepatic carcinoma and various types of head and neck cancer. In addition, the invention contemplates the use of the foregoing composition in place of full-length anti-Her2 antibody in the treatment of HER2-overexpressing cancers as described in U.S. Pat. No. 5,725,856.

In another embodiment, the invention provides a method of treating disorders mediated by CD20-Expressing cells. The invention provides a method for treating a human disease mediated by CD20-expressing cells with a binding fusion protein composition that is derived from a parental antibody that binds to human CD20. Such compositions have prophylactic and therapeutic applications in a broad spectrum of CD20-expressing cell-mediated disorders, including pathologies supported by the proliferation of CD20-expressing cells, such as cancers of CD20-expressing cells, in a manner similar to the application of full length anti-CD20 antibodies in the treatment of such disease indications known in the art, which treatment indications include B-lymphocytic lymphomas, as described in U.S. Pat. No. 6,682,734.

In another embodiment, the invention provides a method of treating disorders mediated by CD18-expressing cells. The invention provides a method for treating a human disease mediated by CD18-expressing cells with a binding fusion protein composition that is derived from a parental antibody that binds to human CD18. Such compositions have prophylactic and therapeutic applications in a broad spectrum of CD18-expressing cell-mediated disorders, including pathologies supported by leukocyte adhesion, in a manner similar to the application of full length anti-CD18 antibodies in the treatment of such disease indications known in the art, which treatment indications include acute myocardial infarction and stroke. In one embodiment, the invention provides a method of treating a disorder in a human patient mediated by a CD18-expressing cell, comprising administering to the patient a therapeutically effective amount of a binding fusion protein wherein at least one targeting moiety in the composition comprises an antigen binding site that binds to human CD18. In another embodiment, the CD18-expressing cell-mediated disorder is an inflammatory disorder, such as an ischemic reperfusion disorder, including acute myocardial infarction and stroke. In addition, the invention contemplates the use of the foregoing binding fusion protein in place of full-length anti-CD18 antibody in the treatment of stroke as described in PCT Publication WO 97/26912.

In another embodiment, the invention provides a method of treating a LFA-1-mediated disorder in a human, comprising administering to the patient a therapeutically effective amount of a binding fusion protein wherein at least one targeting moiety in the composition comprises a targeting moiety that binds to human CD18. In addition, the invention contemplates the use of the foregoing binding fusion protein in place of full-length anti-CD18 antibody in the treatment of a LFA-1-mediated disorder, such as psoriasis and graft rejection, in a human patient as described in U.S. Pat. No. 5,622,700.

In another embodiment, the invention provides a method of treating disorders mediated by CD11a-expressing cells. In one embodiment, the invention provides a method for treating a human disease mediated by a CD11a-expressing cell with a binding fusion protein composition that is derived from a parental antibody that binds to human CD11a. Such compositions have prophylactic and therapeutic applications in a broad spectrum of CD11a-expressing cell-mediated disorders, including pathologies supported by leukocyte adhesion, in a manner similar to the application of full length anti-CD11a antibodies in the treatment of such disease indications known in the art, which treatment indications include psoriasis, asthma, graft rejection, and multiple sclerosis. In another embodiment, the invention provides a method of treating a LFA-1-mediated disorder in a human, comprising administering to the patient a therapeutically effective amount of a binding fusion protein wherein at least one targeting moiety in the composition comprises an antigen binding site that binds to human CD11a. In addition, the invention contemplates the use of the foregoing binding fusion protein in place of full-length anti-CD11a antibody in the treatment of a LFA-1-mediated disorder, such as psoriasis and graft rejection, in a human patient as described in U.S. Pat. No. 5,622,700. In another aspect, the invention contemplates the use of the foregoing binding fusion proteins in place of full-length anti-CD11a antibody in the treatment of LFA-1-mediated disorders in a human patient as described in U.S. Pat. No. 6,037,454.

In another embodiment, the invention provides a method of treating IgE-mediated disorders. In one embodiment, the invention provides a method for treating an IgE-mediated disorder in a human patient with a binding fusion protein composition that is derived from a parental antibody that binds to human IgE. Such compositions have prophylactic and therapeutic applications in a broad spectrum of IgE-mediated disorders, including pathologies characterized by the overproduction and/or hypersensitivity to the immunoglobulin IgE, in a manner similar to the application of anti-IgE antibodies in the treatment of such disease indications known in the art, which treatment indications include allergic diseases, such as allergic asthma and allergic rhinitis. In one embodiment, the invention provides a method of treating an IgE-mediated disorder in a human patient comprising administering to the patient a therapeutically effective amount of a binding fusion protein described wherein at least one targeting moiety comprises an antigen binding site that binds to human IgE. In another embodiment, the IgE-mediated disorder is an allergic disease. In yet another embodiment, the IgE-mediated disorder is allergic asthma. In still another embodiment, the IgE-mediated disorder is allergic rhinitis.

In a further embodiment, the invention provides a method of treating an IgE-mediated disorder in a human patient comprising administering to the patient a therapeutically effective amount of a binding fusion protein wherein at least one targeting moiety in the composition comprises an antigen binding site that competes with human Fc epsilonRI for binding to human IgE. In yet another embodiment, the invention provides a method of treating an IgE-mediated disorder in a human patient comprising administering to the patient a therapeutically effective amount of a binding fusion protein wherein at least one antibody fragment in the binding fusion protein comprises an antigen binding site that binds to membrane-bound IgE on the surface of human B-lymphocytes but does not bind to soluble IgE bound to Fc epsilon RI receptor on the surface of human basophils. In addition, the invention contemplates the use of any of the foregoing binding fusion proteins in place of full length anti-human IgE antibody in the treatment of an IgE-mediated disorder, such as allergic diseases including allergic asthma and allergic rhinitis, in a human patient as described in PCT Application No. WO 99/01556. In another aspect, the invention contemplates the use of any of the foregoing binding fusion proteins in place of full length anti-human IgE antibody in the treatment of allergic asthma in a human patient as described in WO 97/04807.

In another embodiment, the invention provides a method of treating an allergic disease in a human patient comprising administering to the patient a therapeutically effective amount of a binding fusion protein wherein at least one targeting moiety in the binding fusion protein comprises an antigen binding site that competes with human Fc epsilon RI for binding to human IgE. In yet another embodiment, the invention provides a method of treating an allergic disease in a human patient comprising administering to the patient a therapeutically effective amount of a binding fusion protein wherein at least one targeting moiety in the binding fusion protein comprises an antigen binding site that binds to membrane-bound IgE on the surface of human B-lymphocytes but does not bind to soluble IgE bound to Fc epsilon RI receptor on the surface of human basophils.

In another embodiment, the invention provides a method of treating allergic asthma in a human patient comprising administering to the patient a therapeutically effective amount of a binding fusion protein wherein at least one targeting moiety in the binding fusion protein comprises an antigen binding site that competes with human Fc epsilon RI for binding to human IgE. In yet another embodiment, the invention provides a method of treating allergic asthma in a human patient comprising administering to the patient a therapeutically effective amount of any binding fusion protein described in this Section (II) wherein at least one targeting moiety in the binding fusion protein comprises an antigen binding site that binds to membrane-bound IgE on the surface of human B-lymphocytes but does not bind to soluble IgE bound to Fc epsilon RI receptor on the surface of human basophils.

TNF-α-Mediated Disorders

In one embodiment, the invention provides a method for treating a TNF-α-mediated disease with a binding fusion protein that is derived from a parental antibody that binds to human TNF-α. Such binding fusion proteins can have prophylactic and therapeutic applications in a broad spectrum of TNF-α-mediated disorders, including inflammatory disorders and immune disorders, in a manner similar to the application of full-length anti-human TNF-α antibodies in the treatment of such disease indications such as Crohn's disease, inflammatory bowel disease, and rheumatoid arthritis.

In one embodiment, the invention provides a method of treating an inflammatory disorder in a human patient comprising administering to the patient a therapeutically effective amount of a binding fusion protein wherein at least one targeting moiety in the binding fusion protein comprises an antigen binding site that binds to human TNF-α. In another embodiment, the inflammatory disorder is Crohn's disease. In yet another embodiment, the inflammatory disorder is inflammatory bowel disease. In still another embodiment, the inflammatory disorder is rheumatoid arthritis. The use of antibodies that bind to human TNF-α in the treatment of inflammatory conditions have been described, for example, in U.S. Pat. Nos. 5,672,347, 5,656,272, and 5,698,195.

Tissue Factor-Mediated Disorders

In one embodiment, the invention provides a method for treating a tissue factor-mediated disease with a binding fusion protein derived from a parental antibody that binds to human tissue factor. Such binding fusion proteins can have prophylactic and therapeutic applications in a broad spectrum of tissue factor-mediated disorders, including pathologies supported by blood coagulation and in the treatment of such disease indications as deep vein thrombosis, arterial thrombosis, atherosclerosis, vascular stenosis, myocardial ischemic diseases including acute myocardial infarction, reocclusion following angioplasty or atherectomy or thrombolytic treatment for acute myocardial infarction, angina, cerebral ischemic diseases including stroke, venous thrombophlebitis, and pulmonary embolism. In one embodiment, the invention provides a method of treating a tissue factor-mediated disease or disorder (such as the foregoing) in a human patient comprising administering to the patient a therapeutically effective amount of a binding fusion protein wherein at least one targeting moiety in the binding fusion protein comprises an antigen binding site that binds to human tissue factor.

In another embodiment, the invention provides a method of inhibiting blood coagulation in a human patient comprising administering to the patient a therapeutically effective amount of a binding fusion protein wherein at least one targeting moiety in the binding fusion protein comprises an antigen binding site that binds to human tissue factor, preventing the binding of coagulation factor VII.

Disorders Mediated by EGFR-Expressing Cells

In one embodiment, the invention provides a method for treating a human disease mediated by EGFR-expressing cells with a of the binding fusion protein that is derived from a parental antibody that binds to human EGFR (a.k.a., ErbB-1 or Her1). Such binding fusion proteins can have prophylactic and therapeutic applications in a broad spectrum of EGFR-expressing cell-mediated disorders, including pathologies supported by the proliferation of cells expressing EGFR, such as cancers characterized by over-expression of EGFR, including cancers of the breast, ovary, head and neck, brain, bladder, pancreas, and lung.

In one embodiment, the invention provides a method of treating a cell proliferation disorder in a human patient characterized by over-expression of EGFR comprising administering to the patient a therapeutically effective amount of a binding fusion protein wherein at least one targeting moiety in the binding fusion protein comprises an antigen binding site that binds to human EGFR. The disorder can be a benign or malignant tumor characterized by the over-expression of the EGFR, e.g. a cancer, such as, breast cancer, squamous cell cancer, small-cell lung cancer, non-small cell lung cancer, gastrointestinal cancer, pancreatic cancer, glioblastoma, cervical cancer, ovarian cancer, liver cancer, bladder cancer, hepatoma, colon cancer, colorectal cancer, endometrial carcinoma, salivary gland carcinoma, kidney cancer, liver cancer, prostate cancer, vulval cancer, thyroid cancer, hepatic carcinoma and various types of head and neck cancer.

Disorders Mediated by CD3-Expressing Cells

In one embodiment, the invention provides a method for treating a human disease or disorder mediated by CD3-expressing cells with a binding fusion protein that is derived from a parental antibody that binds to human CD3. Such binding fusion proteins can have prophylactic and therapeutic applications in a broad spectrum of CD3-expressing cell-mediated disorders, including conditions associated with the proliferation or activation of cells expressing CD3, such as immune disorders mediated by T-lymphocytes and graft rejection in transplant recipients. The use of anti-CD3 antibodies to treat diseases and disorders has been described, for example, in U.S. Pat. No. 4,515,893. In another aspect, the invention contemplates the use of the foregoing binding fusion protein in place of full length anti-human CD3 antibody in the treatment of acute allograft rejection in kidney transplant recipients as described for ORTHOCLONE OKT3 muromonab-CD3 in *Physician's Desk Reference*, 52$^{nd}$ Edition (1998), pp. 1971-1974.

Disorders Mediated by TAC-Expressing Cells

In one embodiment, the invention provides a method for treating a human disease mediated by interleukin-2 receptor α-chain (TAC)-expressing cells with a binding fusion protein that is derived from a parental antibody that binds to human TAC. Such binding fusion proteins can have prophylactic and therapeutic applications in a broad spectrum of TAC-expressing cell-mediated disorders, including conditions created by the proliferation or activation of cells expressing TAC and immune disorders mediated by T-lymphocytes or B-lymphocytes, including graft rejection in transplant recipients.

In one embodiment, the invention provides a method of treating a disorder in a human patient mediated by a TAC-expressing cell, comprising administering to the patient a therapeutically effective amount of a binding fusion protein wherein at least one targeting moiety in the binding fusion protein comprises an antigen binding site that binds to human TAC. In another embodiment, the TAC-expressing cell-mediated disorder is characterized by the activation or proliferation of T-lymphocytes or B-lymphocytes, including immune disorders such as graft rejection in transplant recipients, graft-versus-host disease (GHVD), graft rejection in transplant recipients, such as acute graft rejection in renal transplant recipients, and autoimmune diseases such as Type I diabetes, multiple sclerosis, rheumatoid arthritis, systemic lupus erythematosus, and myasthenia gravis. The use of antibodies to treat disorders mediated by interleukin-2 receptor α-chain with antibodies has been described in U.S. Pat. No. 5,693,761.

(g) Binding Fusion Protein-Drug Compositions and XTEN-Drug Compositions

The present invention relates in part to compositions of binding fusion proteins covalently linked to a drug, resulting in a binding fusion protein drug conjugate ("BFP-D"). In another aspect, the invention relates to compositions of XTEN covalently linked to a drug, resulting in an XTEN-drug conjugate ("XTEN-D"). In particular, the invention provides isolated BFP-D and XTEN-D compositions useful in the treatment of diseases, disorders or conditions. In one embodiment, the BFP-D comprises one or more targeting moieties of the binding fusion protein directed to an antigen, ligand, or receptor implicated in, associated with, or that modulates a disease, disorder or condition, while one or more XTEN of the binding fusion protein can be designed to serve as a carrier to which the drug is conjugated, conferring a desired half-life or enhanced pharmaceutical property on the binding fusion protein, as described more fully below, and the covalently-linked drug can be selectively delivered to a cell, tissue, or organ to effect a pharmacologic, cytotoxic, or cytostatic effect. Thus, the BFP-D generally comprises one or more of the following components: 1) XTEN; 2) targeting moiety; 3) cross-linker; and 4) drug. The XTEN-D generally comprise one or more of the following components: 1) XTEN; 2) cross-linker; and 3) drug.

Exemplary embodiments of targeting moieties, XTEN and fusion proteins of targeting moieties and XTEN have been described, above. The invention provides XTEN that further serve as a platform to which drugs can be conjugated, such that they serve as a "carrier", conferring certain desirable pharmacokinetic, chemical and pharmaceutical properties to the compositions, amongst other properties described below.

In some embodiments, the XTEN component are engineered to incorporate a defined number of amino acid residues that contain reactive groups that can be used to conjugate to drugs and/or with cross-linking agents. In one embodiment, the reactive amino acid is cysteine ("cysteine-engineered XTEN"). In another embodiment, the reactive amino acid is lysine, which contains a positively charged hydrophilic ε-amino group ("lysine-engineered XTEN"). As used herein, a "cysteine-engineered XTEN" means an XTEN protein, as defined above, further comprising about 1 to about 100 cysteine amino acids, or from 1 to about 50 cysteine amino acids, or from 1 to about 40 cysteine amino acids, or from 1 to about 20 cysteine amino acids, or from 1 to about 10 cysteine amino acids, or from 1 to about 5 cysteine amino acids that are available for conjugation to drug molecules. As used herein, a "lysine-engineered XTEN" means an XTEN protein, as defined above, further comprising about 1 to about 100 lysine amino acids, or from 1 to about 50 lysine amino acids, or from 1 to about 40 lysine engineered amino acids, or from 1 to about 20 lysine engineered amino acids, or from 1 to about 10 lysine engineered amino acids, or from 1 to about 5 lysine engineered amino acids that are available for conjugation to drug molecules.

Generally, XTEN cysteine thiol groups are more reactive, i.e., more nucleophilic, towards electrophilic conjugation reagents than amine or hydroxyl groups. Cysteine residues have been introduced into proteins by genetic engineering techniques to form covalent attachments to ligands or to form new intramolecular disulfide bonds (Better et al (1994) J. Biol. Chem. 13:9644-9650; Bernhard et al (1994) Bioconjugate Chem. 5:126-132; Greenwood et al (1994) Therapeutic Immunology 1:247-255; Tu et al (1999) Proc. Natl. Acad. Sci. USA 96:4862-4867; Kanno et al (2000) J. of Biotechnology, 76:207-214; Chmura et al (2001) Proc. Nat. Acad. Sci. USA 98(15):8480-8484; U.S. Pat. No. 6,248,564).

In one embodiment, the invention provides an isolated composition comprising a cysteine-engineered XTEN conjugated by a cross-linker to one or more drug molecules, wherein the drug is selected from Table 9. In another embodiment, the invention provides an isolated composition comprising a targeted cysteine-engineered XTEN conjugated by a cross-linker to one or more drug molecules, wherein the drug is selected from Table 9 and the targeted cysteine-engineered XTEN comprises one or more targeting moieties that exhibit binding affinity to one or more targets selected from Table 1 or Table 2. In another embodiment, the invention provides an isolated composition comprising a lysine-engineered XTEN conjugated by a cross-linker to one or more drug molecules, wherein the drug is selected from Table 9. In another embodiment, the invention provides an isolated composition comprising a targeted lysine-engineered XTEN conjugated by a cross-linker to one or more drug molecules, wherein the drug is selected from Table 9 and the targeted cysteine-engineered XTEN comprises one or more targeting moieties that exhibits binding affinity to one or more targets selected from Table 1 or Table 2. In one embodiment of the foregoing, only a single drug compound would be conjugated to the XTEN. In another embodiment, more than one drug compound may be conjugated to the XTEN by selective application of the conjugation methods and reactants, using the methods described herein or those known in the art.

In some cases, the compositions of the invention include cysteine-engineered XTEN where nucleotides encoding one or more amino acids of an XTEN are replaced with a cysteine amino acid to create the cysteine-engineered XTEN gene. In other cases, oligonucleotides encoding one or more motifs of about 9 to about 14 amino acids comprising codons encoding one or more cysteines are linked in frame with other oligos encoding XTEN motifs or full-length XTEN to create the cysteine-engineered XTEN gene. In one embodiment of the foregoing, where the one or more cysteines are inserted into an XTEN sequence during the creation of the XTEN gene, nucleotides encoding cysteine can be linked to codons encoding amino acids used in XTEN to create a cysteine-XTEN motif with the cysteine(s) at a defined position using the methods described herein (see Example 61 and FIGS. 40-41), or by standard molecular biology techniques, and the motifs subsequently assembled into the gene encoding the full-length cysteine-engineered XTEN. In such cases, where, for example, nucleotides encoding a single cysteine are added to the DNA encoding a motif selected from Table 3, the resulting motif would have 13 amino acids, while incorporating two cysteines would result in a motif having 14 amino acids, etc. In other cases, a cysteine-motif can be created de novo and be of a pre-defined length and number of cysteine amino acids by linking nucleotides encoding cysteine to nucleotides encoding one or more amino acid residues used in XTEN (e.g., G, S, T, E, P, A) at a defined position, and the encoding motifs subsequently assembled by annealing with other XTEN-encoding motif sequences into the gene encoding the full-length XTEN, as described herein and illustrated in FIGS. 7-8. In cases where a lysine-engineered XTEN is utilized to make the compositions of the invention, the approaches described above would be performed with codons encoding lysine instead of cysteine. Thus, by the foregoing, a new XTEN motif can be created that could comprise about 9-14 amino acid residues and have one or more reactive amino acids; i.e., cysteine or lysine. Non-limiting examples of motifs suitable for use in an engineered XTEN that contain a single cysteine or lysine are:

```
GGSPAGSCTSP        (SEQ ID NO: 174)

GASASCAPSTG        (SEQ ID NO: 175)

GPEPTCPAPSG        (SEQ ID NO: 176)

GGSPAGSKTSP        (SEQ ID NO: 177)

GASASKAPSTG        (SEQ ID NO: 178)
```

In such cases where a gene encoding an XTEN with one or more cysteine and/or lysine motifs is to be constructed from existing XTEN modules, the gene can be designed and built by linking existing "building block" polynucleotides encoding both short- and long-length XTENs; e.g., AE48, AE144, AE288, AE576, AM48, AE864, AM875, AE912, AG864, or the nucleotides encoding the 36'mers of Examples 1-4, etc., which can be fused in frame with the nucleotides encoding the cysteine- and/or lysine-containing motifs to build an engineered XTEN in which the reactive cysteine and/or lysines are placed in one or more selected locations in the sequence in the desired quantity. Non-limiting examples of such engineered XTEN are provided in Table 8.

TABLE 8

Cysteine- and lysine-engineered XTEN

| XTEN Name* | Amino Acid Sequence | SEQ ID NO: |
|---|---|---|
| AE144-Island_Cys1-AE576 | GSEPATSGSETPGTSESATPESGPGSEPATSGSETPGSPAGSPTSTEEGTSTEPSEGSAPG SEPATSGSETPGSEPATSGSETPGSEPATSGSETPGTSTEPSEGSAPGTSESATPESGPGS EPATSGSETPGTSTEPSEGSAPGGGSPAGSCTSPGGSPAGSPTSTEEGTSESATPESGPGT STEPSEGSAPGSPAGSPTSTEEGTSTEPSEGSAPGTSTEPSEGSAPGTSESATPESGPGSEP ATSGSETPGSEPATSGSETPGSPAGSPTSTEEGTSESATPESGPGTSTEPSEGSAPGTSTE PSEGSAPGSPAGSPTSTEEGTSTEPSEGSAPGTSTEPSEGSAPGTSESATPESGPGTSTEPS EGSAPGTSESATPESGPGSEPATSGSETPGTSTEPSEGSAPGTSTEPSEGSAPGTSESATP ESGPGTSESATPESGPGSPAGSPTSTEEGTSESATPESGPGSEPATSGSETPGTSESATPE SGPGTSTEPSEGSAPGTSTEPSEGSAPGTSTEPSEGSAPGTSTEPSEGSAPGTSTEPSEGS APGTSTEPSEGSAPGSPAGSPTSTEEGTSTEPSEGSAPGTSESATPESGPGSEPATSGSET PGTSESATPESGPGSEPATSGSETPGTSESATPESGPGTSTEPSEGSAPGTSESATPESGP GSPAGSPTSTEEGSPAGSPTSTEEGSPAGSPTSTEEGTSESATPESGPGTSTEPSEGSAPG | 179 |
| AE912-Island_Cys2- | MAEPAGSPTSTEEGTPGSGTASSSPGSSTPSGATGSPGASPGTSSTGSPGSPAGSPTSTEE GTSESATPESGPGTSTEPSEGSAPGSPAGSPTSTEEGTSTEPSEGSAPGTSTEPSEGSAPG | 180 |

TABLE 8-continued

Cysteine- and lysine-engineered XTEN

| XTEN Name* | Amino Acid Sequence | SEQ ID NO: |
|---|---|---|
| AE144 | TSESATPESGPGSEPATSGSETPGSEPATSGSETPGSPAGSPTSTEEGTSESATPESGPGT STEPSEGSAPGTSTEPSEGSAPGSPAGSPTSTEEGTSTEPSEGSAPGTSTEPSEGSAPGTS ESATPESGPGTSTEPSEGSAPGTSESATPESGPGSEPATSGSETPGTSTEPSEGSAPGTST EPSEGSAPGTSESATPESGPGTSESATPESGPGSPAGSPTSTEEGTSESATPESGPGSEPA TSGSETPGTSESATPESGPGTSTEPSEGSAPGTSTEPSEGSAPGTSTEPSEGSAPGTSTEPS EGSAPGTSTEPSEGSAPGTSTEPSEGSAPGSPAGSPTSTEEGTSTEPSEGSAPGTSESATP ESGPGSEPATSGSETPGTSESATPESGPGSEPATSGSETPESGPGTSTEPSEG SAPGTSESATPESGPGSPAGSPTSTEEGSPAGSPTSTEEGSPAGSPTSTEEGTSESATPES GPGTSTEPSEGSAPGTSESATPESGPGSEPATSGSETPGTSESATPESGPGSEPATSGSET PGTSESATPESGPGTSTEPSEGSAPGSPAGSPTSTEEGTSESATPESGPGSEPATSGSETP GTSESATPESGPGSPAGSPTSTEEGSPAGSPTSTEEGTSTEPSEGSAPGTSESATPESGPG TSESATPESGPGTSESATPESGPGSEPATSGSETPGSEPATSGSETPGSPAGSPTSTEEGT STEPSEGSAPGTSTEPSEGSAPGSEPATSGSETPGTSESATPESGPGTSTEPSEGSAPGGA SASCAPSTGGGSEPATSGSETPGTSESATPESGPGSEPATSGSETPGSPAGSPTSTEEGTS TEPSEGSAPGSEPATSGSETPGSEPATSGSETPGSEPATSGSETPGTSTEPSEGSAPGTSE SATPESGPGSEPATSGSETPGTSTEPSEGSAPG | |
| AE576-Island_Cys1-AE288 | GSPAGSPTSTEEGTSESATPESGPGTSTEPSEGSAPGSPAGSPTSTEEGTSTEPSEGSAPG TSTEPSEGSAPGTSESATPESGPGSEPATSGSETPGSEPATSGSETPGSPAGSPTSTEEGT SESATPESGPGTSTEPSEGSAPGTSTEPSEGSAPGSPAGSPTSTEEGTSTEPSEGSAPGTS TEPSEGSAPGTSESATPESGPGTSTEPSEGSAPGTSESATPESGPGSEPATSGSETPGTST EPSEGSAPGTSTEPSEGSAPGTSESATPESGPGTSESATPESGPGSPAGSPTSTEEGTSES ATPESGPGSEPATSGSETPGTSESATPESGPGTSTEPSEGSAPGTSTEPSEGSAPGTSTEP SEGSAPGTSTEPSEGSAPGTSTEPSEGSAPGTSTEPSEGSAPGSPAGSPTSTEEGTSTEPS EGSAPGTSESATPESGPGSEPATSGSETPGTSESATPESGPGSEPATSGSETPGTSESATP ESGPGTSTEPSEGSAPGTSESATPESGPGSPAGSPTSTEEGSPAGSPTSTEEGSPAGSPTS TEEGTSESATPESGPGTSTEPSEGSAPGGGSPAGSCTSPGGTSESATPESGPGSEPATSGS ETPGTSESATPESGPGSEPATSGSETPGTSESATPESGPGTSTEPSEGSAPGSPAGSPTST EEGTSESATPESGPGSEPATSGSETPGTSESATPESGPGSPAGSPTSTEEGSPAGSPTSTE EGTSTEPSEGSAPGTSESATPESGPGTSESATPESGPGTSESATPESGPGSEPATSGSETP GSEPATSGSETPGSPAGSPTSTEEGTSTEPSEGSAPGTSTEPSEGSAPGSEPATSGSETPG TSESATPESGPGTSTEPSEGSAPG | 181 |
| AE48-Island_Cys3-AE864 | MAEPAGSPTSTEEGTPGSGTASSSPGSSTPSGATGSPGASPGTSSTGSPGGPEPTCPAPS GGGSPAGSPTSTEEGTSESATPESGPGTSTEPSEGSAPGSPAGSPTSTEEGTSTEPSEGSA PGTSTEPSEGSAPGTSESATPESGPGSEPATSGSETPGSEPATSGSETPGSPAGSPTSTEEG TSESATPESGPGTSTEPSEGSAPGTSTEPSEGSAPGSPAGSPTSTEEGTSTEPSEGSAPG TSTEPSEGSAPGTSESATPESGPGTSTEPSEGSAPGTSESATPESGPGSEPATSGSETPGT STEPSEGSAPGTSTEPSEGSAPGTSESATPESGPGTSESATPESGPGSPAGSPTSTEEGTS ESATPESGPGSEPATSGSETPGTSESATPESGPGTSTEPSEGSAPGTSTEPSEGSAPGTST EPSEGSAPGTSTEPSEGSAPGTSTEPSEGSAPGTSTEPSEGSAPGSPAGSPTSTEEGTSTE PSEGSAPGTSESATPESGPGSEPATSGSETPGTSESATPESGPGSEPATSGSETPGTSESA TPESGPGTSTEPSEGSAPGTSESATPESGPGSPAGSPTSTEEGSPAGSPTSTEEGSPAGSP TSTEEGTSESATPESGPGTSTEPSEGSAPGTSESATPESGPGSEPATSGSETPGTSESATP ESGPGSEPATSGSETPGTSESATPESGPGTSTEPSEGSAPGSPAGSPTSTEEGTSESATPE SGPGSEPATSGSETPGTSESATPESGPGSPAGSPTSTEEGSPAGSPTSTEEGTSTEPSEGS APGTSESATPESGPGTSESATPESGPGTSESATPESGPGSEPATSGSETPGSEPATSGSET PGSPAGSPTSTEEGTSTEPSEGSAPGTSTEPSEGSAPGSEPATSGSETPGTSESATPESGP GTSTEPSEGSAPG | 182 |
| AE288-Island_Cys1-AE288-Island_Cys1-AE288 | GTSESATPESGPGSEPATSGSETPGTSESATPESGPGSEPATSGSETPGTSESATPESGPG TSTEPSEGSAPGSPAGSPTSTEEGTSESATPESGPGSEPATSGSETPGTSESATPESGPGSP AGSPTSTEEGSPAGSPTSTEEGTSTEPSEGSAPGTSESATPESGPGTSESATPESGPGTSE SATPESGPGSEPATSGSETPGSEPATSGSETPGSPAGSPTSTEEGTSTEPSEGSAPGTSTE PSEGSAPGSEPATSGSETPGTSESATPESGPGTSTEPSEGSAPGGGSPAGSCTSPGGTSES ATPESGPGSEPATSGSETPGTSESATPESGPGSEPATSGSETPGTSESATPESGPGTSTEP SEGSAPGSPAGSPTSTEEGTSESATPESGPGSEPATSGSETPGTSESATPESGPGSPAGSP TSTEEGSPAGSPTSTEEGTSTEPSEGSAPGTSESATPESGPGTSESATPESGPGTSESATP ESGPGSEPATSGSETPGSEPATSGSETPGSPAGSPTSTEEGTSTEPSEGSAPGTSTEPSEG SAPGSEPATSGSETPGTSESATPESGPGTSTEPSEGSAPGGGSPAGSCTSPGGTSESATPE SGPGSEPATSGSETPGTSESATPESGPGSEPATSGSETPGTSESATPESGPGTSTEPSEGS APGSPAGSPTSTEEGTSESATPESGPGSEPATSGSETPGTSESATPESGPGSPAGSPTSTE EGSPAGSPTSTEEGTSTEPSEGSAPGTSESATPESGPGTSESATPESGPGTSESATPESGP GSEPATSGSETPGSEPATSGSETPGSPAGSPTSTEEGTSTEPSEGSAPGTSTEPSEGSAPG SEPATSGSETPGTSESATPESGPGTSTEPSEGSAPG | 183 |
| AE48-Island_Cys2-AE576-Island_Cys2-AE144 | MAEPAGSPTSTEEGTPGSGTASSSPGSSTPSGATGSPGASPGTSSTGSPGGASASCAPST GGGSPAGSPTSTEEGTSESATPESGPGTSTEPSEGSAPGSPAGSPTSTEEGTSTEPSEGSA PGTSTEPSEGSAPGTSESATPESGPGSEPATSGSETPGSEPATSGSETPGSPAGSPTSTEE GTSESATPESGPGTSTEPSEGSAPGTSTEPSEGSAPGSPAGSPTSTEEGTSTEPSEGSAPG TSTEPSEGSAPGTSESATPESGPGTSTEPSEGSAPGTSESATPESGPGSEPATSGSETPGT STEPSEGSAPGTSTEPSEGSAPGTSESATPESGPGTSESATPESGPGSPAGSPTSTEEGTS ESATPESGPGSEPATSGSETPGTSESATPESGPGTSTEPSEGSAPGTSTEPSEGSAPGTST EPSEGSAPGTSTEPSEGSAPGTSTEPSEGSAPGTSTEPSEGSAPGSPAGSPTSTEEGTSTE | 184 |

TABLE 8-continued

Cysteine- and lysine-engineered XTEN

| XTEN Name* | Amino Acid Sequence | SEQ ID NO: |
|---|---|---|
| | PSEGSAPGTSESATPESGPGSEPATSGSETPGTSESATPESGPGSEPATSGSETPGTSESA TPESGPGTSTEPSEGSAPGTSESATPESGPGSPAGSPTSTEEGSPAGSPTSTEEGSPAGSP TSTEEGTSESATPESGPGTSTEPSEGSAPGGASASCAPSTGGGSEPATSGSETPGTSESA TPESGPGSEPATSGSETPGSPAGSPTSTEEGTSTEPSEGSAPGSEPATSGSETPGSEPATS GSETPGSEPATSGSETPGTSTEPSEGSAPGTSESATPESGPGSEPATSGSETPGTSTEPSE GSAPG | |
| AM48-<br>Island_Cys1-<br>AM875 | MAEPAGSPTSTEEGASPGTSSTGSPGSSTPSGATGSPGSSTPSGATGSPGGGSPAGSCTS PGGTSTEPSEGSAPGSEPATSGSETPGSPAGSPTSTEEGSTSSTAESPGPGTSTPESGSAS PGSTSESPSGTAPGSTSESPSGTAPGTSTPESGSASPGTSTPESGSASPGSEPATSGSETPG TSESATPESGPGSPAGSPTSTEEGTSTEPSEGSAPGTSTEPSEGSAPGTSTEPSEGSAPGT STEPSEGSAPGSPAGSPTSTEEGTSTEPSEGSAPGTSTEPSEGSAPGTSESATPESGPGTS ESATPESGPGTSTEPSEGSAPGTSTEPSEGSAPGTSESATPESGPGTSTEPSEGSAPGSEP ATSGSETPGSPAGSPTSTEEGSSTPSGATGSPGTPGSGTASSSPGSSTPSGATGSPGTSTE PSEGSAPGTSTEPSEGSAPGSEPATSGSETPGSPAGSPTSTEEGSPAGSPTSTEEGTSTEPS EGSAPGASASGAPSTGGTSESATPESGPGSPAGSPTSTEEGSPAGSPTSTEEGSTSSTAES PGPGSTSESPSGTAPGTSPSGESSTAPGTPGSGTASSSPGSSTPSGATGSPGSSPSASTGT GPGSEPATSGSETPGTSESATPESGPGSEPATSGSETPGTSSTAESPGPGSTSSTAESPG PGTSPSGESSTAPGSEPATSGSETPGSEPATSGSETPGTSTEPSEGSAPGTSSTAESPGP GTSTPESGSASPGSTSESPSGTAPGTSTEPSEGSAPGTSTEPSEGSAPG SSTPSGATGSPGSSPSASTGTGPGASPGTSSTGSPGSEPATSGSETPGTSESATPESGPGS PAGSPTSTEEGSSTPSGATGSPGSSPSASTGTGPGASPGTSSTGSPGTSESATPESGPGTS TEPSEGSAPGTSTEPSEGSAPG | 185 |
| AM48-<br>Island_Cys2-<br>AM1296 | MAEPAGSPTSTEEGASPGTSSTGSPGSSTPSGATGSPGSSTPSGATGSPGGASASCAPST GGGTSTEPSEGSAPGSEPATSGSETPGSPAGSPTSTEEGSTSSTAESPGPGTSTPESGSAS PGSTSESPSGTAPGSTSESPSGTAPGTSTPESGSASPGTSTPESGSASPGSEPATSGSETPG TSESATPESGPGSPAGSPTSTEEGTSTEPSEGSAPGTSESATPESGPGTSTEPSEGSAPGT STEPSEGSAPGSPAGSPTSTEEGTSTEPSEGSAPGTSTEPSEGSAPGTSESATPESGPGTS ESATPESGPGTSTEPSEGSAPGTSTEPSEGSAPGTSESATPESGPGTSTEPSEGSAPGSEP ATSGSETPGSPAGSPTSTEEGSSTPSGATGSPGTPGSGTASSSPGSSTPSGATGSPGTSTE PSEGSAPGTSTEPSEGSAPGSEPATSGSETPGSPAGSPTSTEEGSPAGSPTSTEEGTSTEPS EGSAPGPEPTGPAPSGGSEPATSGSETPGTSESATPESGPGSPAGSPTSTEEGTSESATPE SGPGSPAGSPTSTEEGSPAGSPTSTEEGTSESATPESGPGSPAGSPTSTEEGSPAGSPTST EEGSTSSTAESPGPGSTSESPSGTAPGTSPSGESSTAPGSTSESPSGTAPGSTSESPSGTAP GTSPSGESSTAPGTSTEPSEGSAPGTSESATPESGPGTSESATPESGPGSEPATSGSETPG TSESATPESGPGTSESATPESGPGTSTEPSEGSAPGTSESATPESGPGTSTEPSEGSAPGT SPSGESSTAPGTSPSGESSTAPGTSPSGESSTAPGTSTEPSEGSAPGSPAGSPTSTEEGTST EPSEGSAPGSSPSASTGTGPGSSTPSGATGSPGSSTPSGATGSPGSSTPSGATGSPGSSTP SGATGSPGASPGTSSTGSPGASASGAPSTGGTSPSGESSTAPGSTSSTAESPGPGTSPGE SSTAPGTSESATPESGPGTSTEPSEGSAPGTSTEPSEGSAPGSSPSASTGTGPGSSTPSGA TGSPGASPGTSSTGSPGTSTPESGSASPGTSPSGESSTAPGTSPSGESSTAPGTSESATPES GPGSEPATSGSETPGTSTEPSEGSAPGSTSESPSGTAPGSTSESPSGTAPGSTPESGSASP GSPAGSPTSTEEGTSESATPESGPGTSTEPSEGSAPGSPAGSPTSTEEGTSESATPESGPG SEPATSGSETPGSSTPSGATGSPGASPGTSSTGSPGSSTPSGATGSPGSTSESPSGTAPGT SPSGESSTAPGSTSSTAESPGPGSSTPSGATGSPGASPGTSSTGSPGTPGSGTASSSPGSP AGSPTSTEEGSPAGSPTSTEEGTSTEPSEGSAPG | 186 |
| AM48-<br>Island_Cys3-<br>AM875 | MAEPAGSPTSTEEGASPGTSSTGSPGSSTPSGATGSPGSSTPSGATGSPGGPEPTCPAPS GGGTSTEPSEGSAPGSEPATSGSETPGSPAGSPTSTEEGSTSSTAESPGPGTSTPESGSAS PGSTSESPSGTAPGSTSESPSGTAPGTSTPESGSASPGTSTPESGSASPGSEPATSGSETPG TSESATPESGPGSPAGSPTSTEEGTSTEPSEGSAPGTSTEPSEGSAPGTSTEPSEGSAPGT STEPSEGSAPGSPAGSPTSTEEGTSTEPSEGSAPGTSTEPSEGSAPGTSESATPESGPGTS ESATPESGPGTSTEPSEGSAPGTSTEPSEGSAPGTSESATPESGPGTSTEPSEGSAPGSEP ATSGSETPGSPAGSPTSTEEGSSTPSGATGSPGTPGSGTASSSPGSSTPSGATGSPGTSTE PSEGSAPGTSTEPSEGSAPGSEPATSGSETPGSPAGSPTSTEEGSPAGSPTSTEEGTSTEPS EGSAPGASASGAPSTGGTSESATPESGPGSPAGSPTSTEEGSPAGSPTSTEEGSTSSTAES PGPGSTSESPSGTAPGTSPSGESSTAPGTPGSGTASSSPGSSTPSGATGSPGSSPSASTGT GPGSEPATSGSETPGTSESATPESGPGSEPATSGSETPGTSSTAESPGPGSTSSTAESPG PGTSPSGESSTAPGSEPATSGSETPGSEPATSGSETPGTSTEPSEGSAPGTSSTAESPGP GTSTPESGSASPGSTSESPSGTAPGTSTEPSEGSAPGTSTEPSEGSAPG SSTPSGATGSPGSSPSASTGTGPGASPGTSSTGSPGSEPATSGSETPGTSESATPESGPGS PAGSPTSTEEGSSTPSGATGSPGSSPSASTGTGPGASPGTSSTGSPGTSESATPESGPGTS TEPSEGSAPGTSTEPSEGSAPG | 187 |
| AM48-<br>Island_Cys3-<br>AM875-<br>Island_Cys3-<br>AM48 | MAEPAGSPTSTEEGASPGTSSTGSPGSSTPSGATGSPGSSTPSGATGSPGGPEPTCPAPS GGGTSTEPSEGSAPGSEPATSGSETPGSPAGSPTSTEEGSTSSTAESPGPGTSTPESGSAS PGSTSESPSGTAPGSTSESPSGTAPGTSTPESGSASPGTSTPESGSASPGSEPATSGSETPG TSESATPESGPGSPAGSPTSTEEGTSTEPSEGSAPGTSESATPESGPGTSTEPSEGSAPGT STEPSEGSAPGSPAGSPTSTEEGTSTEPSEGSAPGTSTEPSEGSAPGTSESATPESGPGTS ESATPESGPGTSTEPSEGSAPGTSTEPSEGSAPGTSESATPESGPGTSTEPSEGSAPGSEP ATSGSETPGSPAGSPTSTEEGSSTPSGATGSPGTPGSGTASSSPGSSTPSGATGSPGTSTE PSEGSAPGTSTEPSEGSAPGSEPATSGSETPGSPAGSPTSTEEGSPAGSPTSTEEGTSTEPS EGSAPGASASGAPSTGGTSESATPESGPGSPAGSPTSTEEGSPAGSPTSTEEGSTSSTAES | 188 |

TABLE 8-continued

Cysteine- and lysine-engineered XTEN

| XTEN Name* | Amino Acid Sequence | SEQ ID NO: |
|---|---|---|
| | PGPGSTSESPSGTAPGTSPSGESSTAPGTPGSGTASSSPGSSTPSGATGSPGSSPSASTGT GPGSEPATSGSETPGTSESATPESGPGSEPATSGSETPGTSSTAESPGPGSTSSTAESPG PGTSSPSGESSTAPGSEPATSGSETPGSEPATSGSETPGTSTEPSEGSAPGSTSSTAESPGP GTSTPESGSASPGSTSESPSGTAPGTSTEPSEGSAPGTSTEPSEGSAPGTSTEPSEGSAPG SSTPSGATGSPGSSPSASTGTGPGASPGTSSTGSPGSEPATSGSETPGTSESATPESGPGS PAGSPTSTEEGSSTPSGATGSPGSSPSASTGTGPGASPGTSSTGSPGTSESATPESGPGTS TEPSEGSAPGTSTEPSEGSAPGGPEPTCPAPSGGMAEPAGSPTSTEEGASPGTSSTGSPG SSTPSGATGSPGSSTPSGATGSPG | |
| AE144-Island_Lys1-AE576 | GSEPATSGSETPGTSESATPESGPGSEPATSGSETPGSPAGSPTSTEEGTSTEPSEGSAPG SEPATSGSETPGSEPATSGSETPGSEPATSGSETPGTSTEPSEGSAPGTSESATPESGPGS EPATSGSETPGTSTEPSEGSAPGGGSPAGSKTSPGGSPAGSPTSTEEGTSESATPESGPGT STEPSEGSAPGSPAGSPTSTEEGTSTEPSEGSAPGTSTEPSEGSAPGTSESATPESGPGSEP ATSGSETPGSEPATSGSETPGSPAGSPTSTEEGTSESATPESGPGTSTEPSEGSAPGTSTE PSEGSAPGSPAGSPTSTEEGTSTEPSEGSAPGTSTEPSEGSAPGTSESATPESGPGTSTEPS EGSAPGTSESATPESGPGSEPATSGSETPGTSTEPSEGSAPGTSTEPSEGSAPGTSESATP ESGPGTSESATPESGPGSPAGSPTSTEEGTSESATPESGPGSEPATSGSETPGTSESATPE SGPGTSTEPSEGSAPGTSTEPSEGSAPGTSTEPSEGSAPGTSTEPSEGSAPGTSTEPSEGS APGTSTEPSEGSAPGSPAGSPTSTEEGTSTEPSEGSAPGTSESATPESGPGSEPATSGSET PGTSESATPESGPGSEPATSGSETPGTSESATPESGPGTSTEPSEGSAPGTSESATPESGP GSPAGSPTSTEEGSPAGSPTSTEEGSPAGSPTSTEEGTSESATPESGPGTSTEPSEGSAPG | 189 |
| AE912-Island_Lys2-AE144 | MAEPAGSPTSTEEGTPGSGTASSSPGSSTPSGATGSPGASPGTSSTGSPGSPAGSPTSTEE GTSESATPESGPGTSTEPSEGSAPGSPAGSPTSTEEGTSTEPSEGSAPGTSTEPSEGSAPG TSESATPESGPGSEPATSGSETPGSEPATSGSETPGSPAGSPTSTEEGTSESATPESGPGT STEPSEGSAPGTSTEPSEGSAPGSPAGSPTSTEEGTSTEPSEGSAPGTSTEPSEGSAPGTS ESATPESGPGTSTEPSEGSAPGTSESATPESGPGSEPATSGSETPGTSTEPSEGSAPGTST EPSEGSAPGTSESATPESGPGTSESATPESGPGSPAGSPTSTEEGTSESATPESGPGSEPA TSGSETPGTSESATPESGPGTSTEPSEGSAPGTSTEPSEGSAPGTSTEPSEGSAPGTSTEPS EGSAPGTSTEPSEGSAPGTSTEPSEGSAPGSPAGSPTSTEEGTSTEPSEGSAPGTSESATP ESGPGSEPATSGSETPGTSESATPESGPGSEPATSGSETPGTSESATPESGPGTSTEPSEG SAPGTSESATPESGPGSPAGSPTSTEEGSPAGSPTSTEEGSPAGSPTSTEEGTSESATPES GPGTSTEPSEGSAPGTSESATPESGPGSEPATSGSETPGTSESATPESGPGSEPATSGSET PGTSESATPESGPGTSTEPSEGSAPGSPAGSPTSTEEGTSESATPESGPGSEPATSGSETP GTSESATPESGPGSPAGSPTSTEEGSPAGSPTSTEEGTSTEPSEGSAPGTSESATPESGPG TSESATPESGPGTSESATPESGPGSEPATSGSETPGSPAGSPTSTEEGT STEPSEGSAPGTSTEPSEGSAPGSEPATSGSETPGTSESATPESGPGTSTEPSEGSAPGGA SASKAPSTGGGSEPATSGSETPGTSESATPESGPGSEPATSGSETPGSPAGSPTSTEEGTS TEPSEGSAPGSEPATSGSETPGSEPATSGSETPGSEPATSGSETPGTSTEPSEGSAPGTSE SATPESGPGSEPATSGSETPGTSTEPSEGSAPG | 190 |
| AE576-Island_Lys1-AE288 | GSPAGSPTSTEEGTSESATPESGPGTSTEPSEGSAPGSPAGSPTSTEEGTSTEPSEGSAPG TSTEPSEGSAPGTSESATPESGPGSEPATSGSETPGSEPATSGSETPGSPAGSPTSTEEGT SESATPESGPGTSTEPSEGSAPGTSTEPSEGSAPGSPAGSPTSTEEGTSTEPSEGSAPGTS TEPSEGSAPGTSESATPESGPGTSTEPSEGSAPGTSESATPESGPGSEPATSGSETPGTST EPSEGSAPGTSTEPSEGSAPGTSESATPESGPGTSESATPESGPGSPAGSPTSTEEGTSES ATPESGPGSEPATSGSETPGTSESATPESGPGTSTEPSEGSAPGTSTEPSEGSAPGTSTEP SEGSAPGTSTEPSEGSAPGTSTEPSEGSAPGTSTEPSEGSAPGSPAGSPTSTEEGTSTEPS EGSAPGTSESATPESGPGSEPATSGSETPGTSESATPESGPGSEPATSGSETPGTSESATP ESGPGTSTEPSEGSAPGTSESATPESGPGSPAGSPTSTEEGSPAGSPTSTEEGSPAGSPTS TEEGTSESATPESGPGTSTEPSEGSAPGGGSPAGSKTSPGGTSESATPESGPGSEPATSGS ETPGTSESATPESGPGSEPATSGSETPGTSESATPESGPGTSTEPSEGSAPGSPAGSPTST EEGTSESATPESGPGSEPATSGSETPGTSESATPESGPGSPAGSPTSTEEGSPAGSPTSTE EGTSTEPSEGSAPGTSESATPESGPGTSESATPESGPGTSESATPESGPGSEPATSGSETP GSEPATSGSETPGSPAGSPTSTEEGTSTEPSEGSAPGTSTEPSEGSAPGSEPATSGSETPG TSESATPESGPGTSTEPSEGSAPG | 191 |
| AE48-Island_Lys2-AE864 | MAEPAGSPTSTEEGTPGSGTASSSPGSSTPSGATGSPGASPGTSSTGSPGGASASKAPST GGGSPAGSPTSTEEGTSESATPESGPGTSTEPSEGSAPGSPAGSPTSTEEGTSTEPSEGSA PGTSTEPSEGSAPGTSESATPESGPGSEPATSGSETPGSEPATSGSETPGSPAGSPTSTEE GTSESATPESGPGTSTEPSEGSAPGTSTEPSEGSAPGSPAGSPTSTEEGTSTEPSEGSAPG TSTEPSEGSAPGTSESATPESGPGTSTEPSEGSAPGTSESATPESGPGSPAGSPTSTEEGTS ESATPESGPGSEPATSGSETPGTSESATPESGPGTSTEPSEGSAPGTSTEPSEGSAPGTST EPSEGSAPGTSTEPSEGSAPGTSTEPSEGSAPGSPAGSPTSTEEGT PSEGSAPGTSESATPESGPGSEPATSGSETPGTSESATPESGPGSEPATSGSETPGTSESA TPESGPGTSTEPSEGSAPGTSESATPESGPGSPAGSPTSTEEGSPAGSPTSTEEGSPAGSP TSTEEGTSESATPESGPGTSTEPSEGSAPGTSESATPESGPGSEPATSGSETPGTSESATP ESGPGSEPATSGSETPGTSESATPESGPGTSTEPSEGSAPGSPAGSPTSTEEGTSESATPE SGPGSEPATSGSETPGTSESATPESGPGSPAGSPTSTEEGSPAGSPTSTEEGTSTEPSEGS APGTSESATPESGPGTSESATPESGPGTSESATPESGPGSEPATSGSETPGSEPATSGSET PGSPAGSPTSTEEGTSTEPSEGSAPGTSTEPSEGSAPGSEPATSGSETPGTSESATPESGP GTSTEPSEGSAPG | 192 |

TABLE 8-continued

Cysteine- and lysine-engineered XTEN

| XTEN Name* | Amino Acid Sequence | SEQ ID NO: |
|---|---|---|
| AE288-Island_Lys1-AE288-Island_Lys1-AE288 | GTSESATPESGPGSEPATSGSETPGTSESATPESGPGSEPATSGSETPGTSESATPESGPG TSTEPSEGSAPGSPAGSPTSTEEGTSESATPESGPGSEPATSGSETPGTSESATPESGPGSP AGSPTSTEEGSPAGSPTSTEEGTSTEPSEGSAPGTSESATPESGPGTSESATPESGPGTSE SATPESGPGSEPATSGSETPGSEPATSGSETPGSPAGSPTSTEEGTSTEPSEGSAPGTSTE PSEGSAPGSEPATSGSETPGTSESATPESGPGTSTEPSEGSAPGGGSPAGSKTSPGGTSES ATPESGPGSEPATSGSETPGTSESATPESGPGSEPATSGSETPGTSESATPESGPGTSTEP SEGSAPGSPAGSPTSTEEGTSESATPESGPGSEPATSGSETPGSEPATSGSETPESGPAGSP TSTEEGSPAGSPTSTEEGTSTEPSEGSAPGTSESATPESGPGTSESATPESGPGTSESATP ESGPGSEPATSGSETPGSEPATSGSETPGSPAGSPTSTEEGTSTEPSEGSAPGTSTEPSEG SAPGSEPATSGSETPGTSESATPESGPGTSTEPSEGSAPGGGSPAGSKTSPGGTSESATPE SGPGSEPATSGSETPGTSESATPESGPGSEPATSGSETPGTSESATPESGPGTSTEPSEGS APGSPAGSPTSTEEGTSESATPESGPGSEPATSGSETPGTSESATPESGPGSPAGSPTSTE EGSPAGSPTSTEEGTSTEPSEGSAPGTSESATPESGPGTSESATPESGPGTSESATPESGP GSEPATSGSETPGSEPATSGSETPGSPAGSPTSTEEGTSTEPSEGSAPGTSTEPSEGSAPG SEPATSGSETPGTSESATPESGPGTSTEPSEGSAPG | 193 |
| AE48-Island_Lys1-AE576-Island_Lys1-AE144 | MAEPAGSPTSTEEGTPGSGTASSSPGSSTPSGATGSPGASPGTSSTGSPGGGSPAGSKTS PGGSPAGSPTSTEEGTSESATPESGPGTSTEPSEGSAPGSPAGSPTSTEEGTSTEPSEGSA PGTSTEPSEGSAPGTSESATPESGPGSEPATSGSETPGSEPATSGSETPGSPAGSPTSTEE GTSESATPESGPGTSTEPSEGSAPGTSTEPSEGSAPGSPAGSPTSTEEGTSTEPSEGSAPG TSTEPSEGSAPGTSESATPESGPGTSTEPSEGSAPGTSESATPESGPGSEPATSGSETPGT STEPSEGSAPGTSTEPSEGSAPGTSESATPESGPGTSESATPESGPGSPAGSPTSTEEGTS ESATPESGPGSEPATSGSETPGTSESATPESGPGTSTEPSEGSAPGTSTEPSEGSAPGTST EPSEGSAPGTSTEPSEGSAPGTSTEPSEGSAPGTSTEPSEGSAPGSPAGSPTSTEEGTSTE PSEGSAPGTSESATPESGPGSEPATSGSETPGTSESATPESGPGSEPATSGSETPGTSESA TPESGPGTSTEPSEGSAPGTSESATPESGPGSPAGSPTSTEEGSPAGSPTSTEEGSPAGSP TSTEEGTSESATPESGPGTSTEPSEGSAPGGGSPAGSKTSPGGSEPATSGSETPGTSESAT PESGPGSEPATSGSETPGSPAGSPTSTEEGTSTEPSEGSAPGSEPATSGSETPGSEPATSG SETPGSEPATSGSETPGTSTEPSEGSAPGTSESATPESGPGSEPATSGSETPGTSTEPSEGS APG | 194 |
| AM48-Island_Lys1-AM875 | MAEPAGSPTSTEEGASPGTSSTGSPGSSTPSGATGSPGSSTPSGATGSPGGGSPAGSKTS PGGTSTEPSEGSAPGSEPATSGSETPGSPAGSPTSTEEGSTSSTAESPGPGTSTPESGSAS PGSTSESPSGTAPGSTSESPSGTAPGTSTPESGSASPGTSTPESGSASPGSEPATSGSETPG TSESATPESGPGSPAGSPTSTEEGTSTEPSEGSAPGTSESATPESGPGTSTEPSEGSAPGT STEPSEGSAPGSPAGSPTSTEEGTSTEPSEGSAPGTSTEPSEGSAPGTSESATPESGPGTS ESATPESGPGTSTEPSEGSAPGTSTEPSEGSAPGTSESATPESGPGTSTEPSEGSAPGSEP ATSGSETPGSPAGSPTSTEEGSSTPSGATGSPGTPGSGTASSSPGSSTPSGATGSPGTSTE PSEGSAPGTSTEPSEGSAPGSEPATSGSETPGSPAGSPTSTEEGSPAGSPTSTEEGTSTEPS EGSAPGASASGAPSTGGTSESATPESGPGSPAGSPTSTEEGSPAGSPTSTEEGTSSSTAES PGPGSTSESPSGTAPGTSPSGESSTAPGTPGSGTASSSPGSSTPSGATGSPGSSPSASTGT GPGSEPATSGSETPGTSESATPESGPGSEPATSGSETPGTSSTAESPGPGSTSSTAESPG PGTSPSGESSTAPGSEPATSGSETPGSEPATSGSETPGTSTEPSEGSAPGSTSSTAESPGP GTSTPESGSASPGSTSESPSGTAPGTSTEPSEGSAPGTSTEPSEGSAPG SSTPSGATGSPGSSPSASTGTGPGASPGTSSTGSPGSEPATSGSETPGTSESATPESGPGS PAGSPTSTEEGSSTPSGATGSPGSSPSASTGTGPGASPGTSSTGSPGTSESATPESGPGTS TEPSEGSAPGTSTEPSEGSAPG | 195 |
| AM48-Island_Lys2-AM1296 | MAEPAGSPTSTEEGASPGTSSTGSPGSSTPSGATGSPGSSTPSGATGSPGGASASKAPST GGGTSTEPSEGSAPGSEPATSGSETPGSPAGSPTSTEEGSPAGSPTSTEEGTSTPESGSAS PGSTSESPSGTAPGSTSESPSGTAPGTSTPESGSASPGTSTPESGSASPGSEPATSGSETPG TSESATPESGPGSPAGSPTSTEEGTSTEPSEGSAPGTSESATPESGPGTSTEPSEGSAPGT STEPSEGSAPGSPAGSPTSTEEGTSTEPSEGSAPGTSTEPSEGSAPGTSESATPESGPGTS ESATPESGPGTSTEPSEGSAPGTSTEPSEGSAPGTSESATPESGPGTSTEPSEGSAPGSEP ATSGSETPGSPAGSPTSTEEGSSTPSGATGSPGTPGSGTASSSPGSSTPSGATGSPGTSTE PSEGSAPGTSTEPSEGSAPGSEPATSGSETPGSPAGSPTSTEEGSPAGSPTSTEEGTSTEPS EGSAPGPEPTGPAPSGGSEPATSGSETPGTSESATPESGPGSPAGSPTSTEEGTSESATPE SGPGSPAGSPTSTEEGSPAGSPTSTEEGTSESATPESGPGSPAGSPTSTEEGSPAGSPTST EEGTSSSTAESPGPGSTSESPSGTAPGTSPSGESSTAPGSTSESPSGTAPGSTSESPSGTAP GTSPSGESSTAPGTSTEPSEGSAPGTSESATPESGPGTSESATPESGPGSEPATSGSETPG TSESATPESGPGTSESATPESGPGTSTEPSEGSAPGTSESATPESGPGTSTEPSEGSAPGT SPSGESSTAPGTSPSGESSTAPGTSPSGESSTAPGTSTEPSEGSAPGSPAGSPTSTEEGTSST EPSEGSAPGSSPSASTGTGPGSSTPSGATGSPGSSTPSGATGSPGSSTPSGATGSPGSSTP SGATGSPGASPGTSSTGSPGASASGAPSTGGTSPSGESSTAPGSTSSTAESPGPGTSPSGE SSTAPGTSESATPESGPGTSTEPSEGSAPGTSTEPSEGSAPGSSPSASTGTGPGSSTPSGA TGSPGASPGTSSTGSPGTSTPESGSASPGTSPSGESSTAPGSPSGESSTAPGTSESATPES GPGSEPATSGSETPGTSTEPSEGSAPGTSESPSGTAPGTSESPSGTAPGTSTPESGSASP GSPAGSPTSTEEGTSESATPESGPGTSTEPSEGSAPGSPAGSPTSTEEGTSESATPESGPG SEPATSGSETPGSSTPSGATGSPGASPGTSSTGSPGSSTPSGATGSPGSTSESPSGTAPGT SPSGESSTAPGSTSSTAESPGPGSSTPSGATGSPGASPGTSSTGSPGTPGSGTASSSPGSP AGSPTSTEEGSPAGSPTSTEEGTSTEPSEGSAPG | 196 |

TABLE 8-continued

Cysteine- and lysine-engineered XTEN

| XTEN Name* | Amino Acid Sequence | SEQ ID NO: |
|---|---|---|
| AM48-<br>Island_Lys2-<br>AM875 | MAEPAGSPTSTEEGASPGTSSTGSPGSSTPSGATGSPGSSTPSGATGSPGGASASKAPST<br>GGGTSTEPSEGSAPGSEPATSGSETPGSPAGSPTSTEEGSTSSTAESPGPGTSTPESGSAS<br>PGSTSESPSGTAPGSTSESPSGTAPGTSTPESGSASPGTSTPESGSASPGSEPATSGSETPG<br>TSESATPESGPGSPAGSPTSTEEGTSTEPSEGSAPGTSESATPESGPGTSTEPSEGSAPGT<br>STEPSEGSAPGSPAGSPTSTEEGTSTEPSEGSAPGTSTEPSEGSAPGTSESATPESGPGTS<br>ESATPESGPGTSTEPSEGSAPGTSTEPSEGSAPGTSESATPESGPGTSTEPSEGSAPGSEP<br>ATSGSETPGSPAGSPTSTEEGSSTPSGATGSPGTPGSGTASSSPGSSTPSGATGSPGTSTE<br>PSEGSAPGTSTEPSEGSAPGSEPATSGSETPGSPAGSPTSTEEGSPAGSPTSTEEGTSTEPS<br>EGSAPGASASGAPSTGGTSESATPESGPGSPAGSPTSTEEGSPAGSPTSTEEGTSTSSTAES<br>PGPGSTSESPSGTAPGTSPSGESSTAPGTPGSGTASSSPGSSTPSGATGSPGSSPSASTGT<br>GPGSEPATSGSETPGTSESATPESGPGSEPATSGSETPGTSSTAESPGPGSTSSTAESPG<br>PGTSPSGESSTAPGSEPATSGSETPGSEPATSGSETPGTSTEPSEGSAPGSTSSTAESPGP<br>GTSTPESGSASPGSTSESPSGTAPGTSTEPSEGSAPGTSTEPSEGSAPGTSTEPSEGSAPG<br>SSTPSGATGSPGSSPSASTGPGASPGTSSTGSPGSEPATSGSETPGTSESATPESGPGS<br>PAGSPTSTEEGSSTPSGATGSPGSSPSASTGTGPGASPGTSSTGSPGTSESATPESGPGTS<br>TEPSEGSAPGTSTEPSEGSAPG | 197 |
| AM48-<br>Island_Lys2-<br>AM875-<br>Island_Lys2-<br>AM48 | MAEPAGSPTSTEEGASPGTSSTGSPGSSTPSGATGSPGSSTPSGATGSPGGASASKAPST<br>GGGTSTEPSEGSAPGSEPATSGSETPGSPAGSPTSTEEGSTSSTAESPGPGTSTPESGSAS<br>PGSTSESPSGTAPGSTSESPSGTAPGTSTPESGSASPGTSTPESGSASPGSEPATSGSETPG<br>TSESATPESGPGSPAGSPTSTEEGTSTEPSEGSAPGTSESATPESGPGTSTEPSEGSAPGT<br>STEPSEGSAPGSPAGSPTSTEEGTSTEPSEGSAPGTSTEPSEGSAPGTSESATPESGPGTS<br>ESATPESGPGTSTEPSEGSAPGTSTEPSEGSAPGTSESATPESGPGTSTEPSEGSAPGSEP<br>ATSGSETPGSPAGSPTSTEEGSSTPSGATGSPGTPGSGTASSSPGSSTPSGATGSPGTSTE<br>PSEGSAPGTSTEPSEGSAPGSEPATSGSETPGSPAGSPTSTEEGSPAGSPTSTEEGTSTEPS<br>EGSAPGASASGAPSTGGTSESATPESGPGSPAGSPTSTEEGSPAGSPTSTEEGTSTSSTAES<br>PGPGSTSESPSGTAPGTSPSGESSTAPGTPGSGTASSSPGSSTPSGATGSPGSSPSASTGT<br>GPGSEPATSGSETPGTSESATPESGPGSEPATSGSETPGTSSTAESPGPGSTSSTAESPG<br>PGTSPSGESSTAPGSEPATSGSETPGSEPATSGSETPGTSTEPSEGSAPGSTSSTAESPGP<br>GTSTPESGSASPGSTSESPSGTAPGTSTEPSEGSAPGTSTEPSEGSAPGTSTEPSEGSAPG<br>SSTPSGATGSPGSSPSASTGPGASPGTSSTGSPGSEPATSGSETPGTSESATPESGPGS<br>PAGSPTSTEEGSSTPSGATGSPGSSPSASTGTGPGASPGTSSTGSPGTSESATPESGPGTS<br>TEPSEGSAPGTSTEPSEGSAPGGASASKAPSTGGMAEPAGSPTSTEEGASPGTSSTGSPG<br>SSTPSGATGSPGSSTPSGATGSPG | 198 |
| AE288-<br>Island_Cys1-<br>AE288-<br>Island_Lys1-<br>AE288 | GTSESATPESGPGSEPATSGSETPGTSESATPESGPGSEPATSGSETPGTSESATPESGPG<br>TSTEPSEGSAPGSPAGSPTSTEEGTSESATPESGPGSEPATSGSETPGTSESATPESGPGSP<br>AGSPTSTEEGSPAGSPTSTEEGTSTEPSEGSAPGTSESATPESGPGTSESATPESGPGTSE<br>SATPESGPGSEPATSGSETPGSEPATSGSPAGSPTSTEEGTSTEPSEGSAPGTSTE<br>PSEGSAPGSEPATSGSETPGTSESATPESGPGTSTEPSEGSAPGGGSPAGSCTSPGGTSES<br>ATPESGPGSEPATSGSETPGTSESATPESGPGSEPATSGSETPGTSESATPESGPGTSTEP<br>SEGSAPGSPAGSPTSTEEGTSESATPESGPGSEPATSGSETPGTSESATPESGPGSPAGSP<br>TSTEEGSPAGSPTSTEEGTSTEPSEGSAPGTSESATPESGPGTSESATPESGPGTSESATP<br>ESGPGSEPATSGSETPGSEPATSGSETPGSPAGSPTSTEEGTSTEPSEGSAPGTSTEPSEG<br>SAPGSEPATSGSETPGTSESATPESGPGTSTEPSEGSAPGGGSPAGSKTSPGGTSESATPE<br>SGPGSEPATSGSETPGTSESATPESGPGSEPATSGSETPGTSESATPESGPGTSTEPSEGS<br>APGSPAGSPTSTEEGTSESATPESGPGSEPATSGSETPGTSESATPESGPGSPAGSPTSTE<br>EGSPAGSPTSTEEGTSTEPSEGSAPGTSESATPESGPGTSESATPESGPGTSESATPESGP<br>GSEPATSGSETPGSEPATSGSETPGSPAGSPTSTEEGTSTEPSEGSAPGTSTEPSEGSAPG<br>SEPATSGSETPGTSESATPESGPGTSTEPSEGSAPG | 199 |
| AE48-<br>Island_Cys1-<br>AE144-<br>Island_Cys1-<br>AE144-<br>Island_Cys1-<br>AE144-<br>Island_Cys1-<br>AE144 | MAEPAGSPTSTEEGTPGSGTASSSPGSSTPSGATGSPGASPGTSSTGSPGGGSPAGSCTS<br>PGGSEPATSGSETPGTSESATPESGPGSEPATSGSETPGSPAGSPTSTEEGTSTEPSEGSA<br>PGSEPATSGSETPGSEPATSGSETPGSEPATSGSETPGTSTEPSEGSAPGTSESATPESGP<br>GSEPATSGSETPGTSTEPSEGSAPGGGSPAGSCTSPGGSEPATSGSETPGTSESATPESGP<br>SEPATSGSETPGSPAGSPTSTEEGTSTEPSEGSAPGSEPATSGSETPGSEPATSGSETPGS<br>EPATSGSETPGTSTEPSEGSAPGTSESATPESGPGSEPATSGSETPGTSTEPSEGSAPGGG<br>SPAGSCTSPGGSEPATSGSETPGTSESATPESGPGSEPATSGSETPGSPAGSPTSTEEGTS<br>TEPSEGSAPGSEPATSGSETPGSEPATSGSETPGSEPATSGSETPGTSTEPSEGSAPGTSE<br>SATPESGPGSEPATSGSETPGTSTEPSEGSAPGGGSPAGSCTSPGGSEPATSGSETPGTSE<br>SATPESGPGSEPATSGSETPGSPAGSPTSTEEGTSTEPSEGSAPGSEPATSGSETPGSEPA<br>TSGSETPGSEPATSGSETPGTSTEPSEGSAPGTSESATPESGPGSEPATSGSETPGTSTEPS<br>EGSAPG | 200 |
| AE48-<br>Island_Lys1-<br>AE144-<br>Island_Lys1-<br>AE144-<br>Island_Lys1-<br>AE144-<br>Island_Lys1-<br>AE144 | MAEPAGSPTSTEEGTPGSGTASSSPGSSTPSGATGSPGASPGTSSTGSPGGGSPAGSKTS<br>PGGSEPATSGSETPGTSESATPESGPGSEPATSGSETPGSPAGSPTSTEEGTSTEPSEGSA<br>PGSEPATSGSETPGSEPATSGSETPGSEPATSGSETPGTSTEPSEGSAPGTSESATPESGP<br>GSEPATSGSETPGTSTEPSEGSAPGGGSPAGSKTSPGGSEPATSGSETPGTSESATPESGP<br>SEPATSGSETPGSPAGSPTSTEEGTSTEPSEGSAPGSEPATSGSETPGSEPATSGSETPGS<br>EPATSGSETPGTSTEPSEGSAPGTSESATPESGPGSEPATSGSETPGTSTEPSEGSAPGGG<br>SPAGSKTSPGGSEPATSGSETPGTSESATPESGPGSEPATSGSETPGSPAGSPTSTEEGTS<br>TEPSEGSAPGSEPATSGSETPGSEPATSGSETPGSEPATSGSETPGTSTEPSEGSAPGTSE<br>SATPESGPGSEPATSGSETPGTSTEPSEGSAPGGGSPAGSKTSPGGSEPATSGSETPGTSE | 201 |

TABLE 8-continued

Cysteine- and lysine-engineered XTEN

| XTEN Name* | Amino Acid Sequence | SEQ ID NO: |
|---|---|---|
| | SATPESGPGSEPATSGSETPGSPAGSPTSTEEGTSTEPSEGSAPGSEPATSGSETPGSEPA TSGSETPGSEPATSGSETPGTSTEPSEGSAPGTSESATPESGPGSEPATSGSETPGTSTEPS EGSAPG | |

In another embodiment, where an existing full-length XTEN gene is to be modified with nucleotides encoding one or more reactive cysteine or lysine residues, an oligonucleotide can be created that encodes a cysteine or lysine and that exhibits partial homology to and can hybridize with one or more short sequences of the XTEN, resulting in a recombination event and substitution of a cysteine or the lysine codon for an existing codon of the XTEN gene (see, e.g., Example 61 for a description of the general methods). In one embodiment, the recombination results in a replacement with the amino acid sequence GGSPAGSCTSP. However, the oligonucleotides can be designed to place the cysteine (or lysine) in a different location in the motif or to include a second cysteine (or lysine) in the motif. The cysteine- or lysine-encoding oligonucleotides can be designed to hybridize with a given sequence segment at different points along the known XTEN sequence. Thus, the invention contemplates that multiple XTEN gene constructs can be created with cysteines or lysines inserted at different locations within the XTEN sequence by the selection of restriction sites within the XTEN sequence and the design of oligonucleotides appropriate for the given location and that encode a cysteine or lysine, including use of designed oligonucleotides that result in multiple insertions in the same XTEN sequence. By the design and selection of one or more such oligonucleotides in consideration of the known sequence of the XTEN, and the appropriate use of the methods of the invention, the potential number of substituted reactive cysteine or lysine residues inserted into the full-length XTEN can be estimated and then confirmed by sequencing the XTEN gene.

Figure 45:
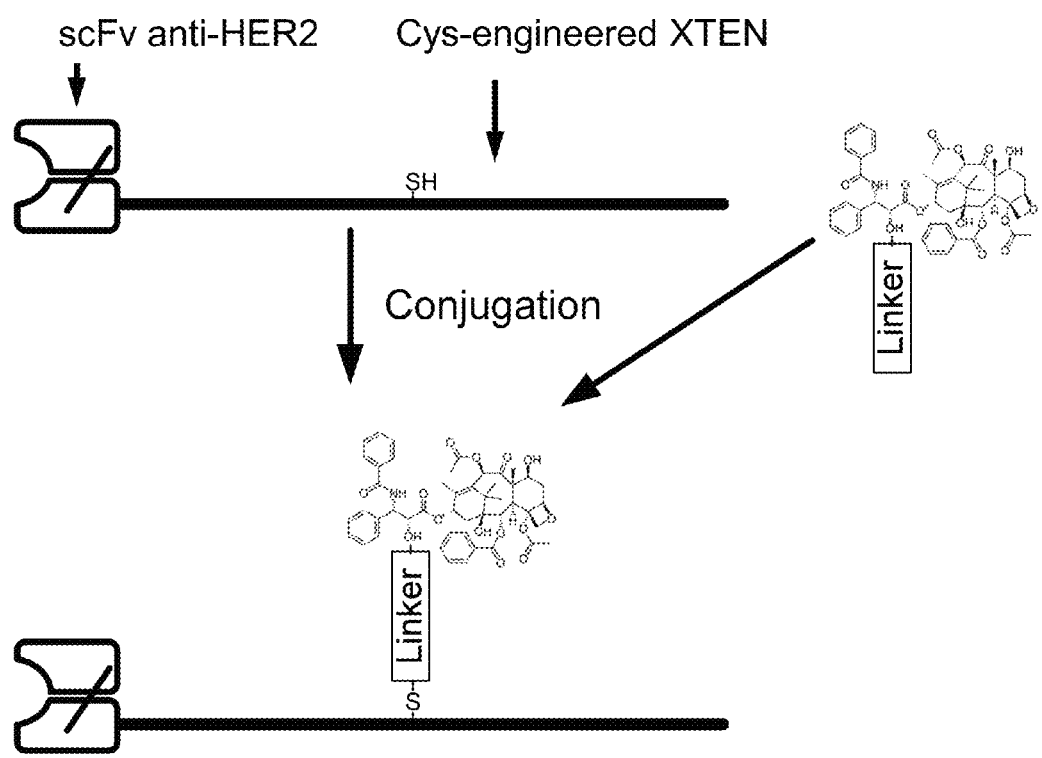
FIG. 45 shows a schematic of the orthogonal chemistry process to create a BFP-D comprising a scFv anti-HER2 with paclitaxel conjugated to the XTEN, resulting in aHER2-XTEN-CL-paclitaxel. The paclitaxel is first reacted with an activated linker, then conjugated to a cysteine-engineered XTEN, as described in Example 66.

The design, selection, and preparation methods of the invention enable the creation of engineered XTEN that are reactive with electrophilic functionality. These methods further enable creation of XTEN-drug conjugate compositions with drug molecules at designated, designed, and selective sites, as illustrated schematically in FIGS. 40-41. Drugs may be site-specifically and efficiently coupled to cysteine-engineered XTEN and targeted cysteine-engineered XTEN of the invention with a thiol-reactive reagent. For example, reactive cysteine residues on a cysteine-engineered XTEN allow specifically conjugating a drug moiety to each cysteine of the XTEN sequence by cross-linking with a thiol reactive group such as maleimide or haloacetyl. FIG. 45 illustrates a specific example of the conjugation of pacitaxel to an anti-Her2 binding, fusion protein by this approach. Generally, the nucleophilic reactivity of the thiol functionality of a cysteine residue to a maleimide group is about 1000 times higher compared to an other amino acid functionality in a protein, such as amino group of lysine residues or the N-terminal amino group. Thiol specific functionality in iodoacetyl and maleimide reagents may react with amine groups, but higher pH (>9.0) and longer reaction times are required (Garman, 1997, Non-Radioactive. Labelling: A Practical Approach, Academic Press, London). Typically, conjugation reactions with cysteine are suitably performed at a pH below about 7, using reaction temperatures in the range of from about 5 up to about 40° C., and preferably in the range of from 10 up to 30° C. (see U.S. Pat. No. 6,048,720).

1. Drugs

The drugs to be incorporated into the BFP-D and XTEN-drug compositions of the invention have one or more pharmacologic activities. The drugs may include a cytotoxic or cytostatic agent (e.g., epaclitaxel, paclitaxel, docetaxel, doxetaxel, irinotecan, pemetrexed, chloranbucil, or gemcitabine), an anti-inflammatory agent, an opiod (e.g. morphine, oxycodone, hydromorphone), an analgesic, an anti-infective, or a fluorophore such as a fluorescent dye like fluorescein or rhodamine, a chelating agent for an imaging or radiotherapeutic metal, a peptidyl or non-peptidyl label or detection tag. In particular, drugs that have a high incidence of side effects or toxicity, or those for which localization at the site of disease or pathology is desired, are contemplated for incorporation into the BFP-D or XTEN-drug conjugates of the invention.

Exemplary drugs for incorporation into the compositions of the invention are set forth in the official United States Pharmacopeia, official Homeopathic Pharmacopeia of the United States, or official National Formulary, in the Physician's Desk Reference (PDR) and in the Orange Book maintained by the U.S. Food and Drug Administration (FDA). Preferred drugs are those having the needed reactive functional group or those that can be readily derivatized to provide the reactive functional group for conjugation and will retain at least a portion of the pharmacologic activity of the unconjugated drug when conjugated to XTEN. In one embodiment, the drug for conjugation to the subject XTEN or fusion proteins disclosed herein is an agent selected from Table 9, or a pharmaceutically acceptable salt, acid or derivative thereof.

TABLE 9

Drugs for Conjugation to Engineered XTEN

Drugs

Erlotinib; Bortezomib; Fulvestrant; Sutent (SU11248), Letrozole; Imatinib mesylate; PTK787/ZK 222584; Oxaliplatin; 5-FU (5-fluorouracil), leucovorin, rapamycin; lapatinib; lonafarnib; sorafenib; gefitinib; thiotepa; cyclosphosphamide; busulfan; improsulfan; piposulfan; benzodopa; carboquone; meturedopa; uredopa; altretamine; triethylenemelamine; triethylenephosphoramide; triethylenethiophosphoramide; trimethylomelamine; bullatacin; bullatacinone; camptothecin; topotecan; bryostatin; callystatin; CC-1065; adozelesin; calicheamycin; auristatin; carzelesin; bizelesin; cryptophycins (particularly cryptophycin 1 and cryptophycin 8); dolastatin;

TABLE 9-continued

Drugs for Conjugation to Engineered XTEN

Drugs duocarmycin; eleutherobin; pancratistatin; sarcodictyin; spongistatin; chlorambucil; chlornaphazine;
cholophosphamide; estramustine; ifosfamide; mechlorethamine; mechlorethamine oxide hydrochloride,
melphalan; novembichin; phenesterine; prednimustine; trofosfamide; uracil mustard; carmustine; chlorozotocin;
fotemustine; lomustine; nimustine; ranimnustine; calicheamicin; dynemicin; dynemicin A; clodronate;
esperamicin; neocarzinostatin chromophore; aclacinomysins, actinomycin; anthramycin; azaserine; bleomycin;
cactinomycin; carabicin; carminomycin; carzinophilin; chromomycinis; dactinomycin; daunorubicin; detorubicin;
6-diazo-5-oxo-L-norleucine; doxorubicin (including morpholino-doxorubicin, cyanomorpholino-doxorubicin, 2-
pyrrolino-doxorubicin and deoxydoxorubicin); epirubicin; esorubicin; idarubicin; marcellomycin; mitomycin C;
mycophenolic acid; nogalamycin; olivomycin; peplomycin; potfiromycin; puromycin; quelamycin; rodorubicin;
streptonigrin; streptozocin; tubercidin; ubenimex; zinostatin; zorubicin; methotrexate; 5-fluorouracil (5-FU);
fdenopterin; methotrexate; pteropterin; trimetrexate; fludarabine; 6-mercaptopurine; thiamiprine; thioguanine;
ancitabine; azacitidine; 6-azauridine; carmofur; cytarabine; dideoxyuridine; doxifluridine; enocitabine;
floxuridine; calusterone; dromostanolone propionate; epitiostanol; mepitiostane; testolactone; aminoglutethimide;
mitotane; trilostane; frolinic acid; aceglatone; aldophosphamide glycoside; aminolevulinic acid; eniluracil;
amsacrine; bestrabucil; bisantrene; edatraxate; defofamine; demecolcine; diaziquone; elformithine; elliptinium
acetate; an epothilone; etoglucid; gallium nitrate; hydroxyurea; lentinan; lonidainine; maytansine; ansamitocins;
mitoguazone; mitoxantrone; mopidanmol; nitraerine; pentostatin; phenamet; pirarubicin; losoxantrone;
podophyllinic acid; 2-ethylhydrazide; procarbazine; razoxane; rhizoxin; ribavirin; zidovudine; acyclovir;
gangcyclovir; vidarabine; idoxuridine; trifluridine; foscarnet; amantadine; rimantadine; saquinavir; indinavir;
ritonavir; alpha-interferons and other interferons; AZT; sizofuran; spirogermanium; tenuazonic acid; triaziquone;
2;2',2''-trichlorotriethylamine; T-2 toxin; verracurin A; roridin A; anguidine); urethan; vindesine; dacarbazine;
mannomustine; mitobronitol; mitolactol; pipobroman; gacytosine; arabinoside ("Ara-C"); cyclophosphamide;
thiotepa; taxoids; epaclitaxel; paclitaxel; docetaxel; doxetaxel; irinotecan; pemetrexed chloranbucil; gemcitabine;
6-thioguanine; mercaptopurine; methotrexate; cisplati; carboplatin; vinblastine; platinum; etoposide (VP-16);
ifosfamide; mitoxantrone; vincristine; vinorelbine; novantrone; teniposide; edatrexate; daunomycin; aminopterin;
xeloda; ibandronate; CPT-11; topoisomerase inhibitor RFS 2000; difluoromethylornithine (DMFO); retinoic acid;
capecitabine; lidocaine; bupivacaine; memantine; donepezil; rivastigmine; galantamine; morphine; oxycodone;
hydromorphone; oxymorphone; metopon; apomorphine; normorphine; etorphine; buprenorphine; meperidine;
lopermide; anileridine; ethoheptazine; piminidine; betaprodine; diphenoxylate; fentanil; sufentanil; alfentanil;
remifentanil; levorphanol; dextromethorphan; phenazocine; pentazocine; cyclazocine; methadone; isomethadone;
propoxyphene; naloxone; naltrexone; treprostinil; N-methylnaloxone; 6-amino-14-hydroxy-17-
allylnordesomorphine; naltrendol;, N-methylnaltrexone; nalbuphine; butorphanol; cyclazocine; pentazocine,;
nalmephene; naltrindole; nor-binaltorphimine; oxilorphan; 6-amino-6-desoxo-naloxone; pentazocine;
levallorphanmethylnaltrexone; buprenorphine; cyclorphan; levalorphan; cyclosporine; cyclosporine A;
mycophenylate mofetil; sirolimus; tacrolimus; prednisone; azathioprine; methotrexate; cyclophosphamide;
prednisone; aminocaproic acid; chloroquine; hydroxychloroquine; dexamethasone; chlorambucil; danazol;
bromocriptine 2. Conjugation: Cross-Linkers and Methods The conjugation between the polypeptide (either an XTEN or a fusion partner, such as a targeting moiety) and the drug compound, optionally through a cross-linker, may be done according to methods known in the art, e.g. as described by Bodanszky in Peptide Synthesis, John Wiley, New York, 1976 and in WO 96/12505; Harris and Zalipsky, eds., Poly(ethylene glycol) Chemistry and Biological Applications, AZC, Washington; R. F. Taylor, (1991), "Protein immobilisation. Fundamental and applications", Marcel Dekker, N.Y.; S. S. Wong, (1992), "Chemistry of Protein Conjugation and Crosslinking", CRC Press, Boca Raton; G. T. Hermanson et al., (1993), "Immobilized Affinity Ligand Techniques", Academic Press, N.Y.; as well as in U.S. Pat. Nos. 5,977,163, 6,262,107, 6,441,025, 7,026,440, 7,329,721, 7,528,202, 7,579,444, 7,659,361 and 7,851,437; U.S. Patent App. Publication Nos. 2002001628, 20020077290, 20040157782, and 20050238649; and PCT Publication Nos. WO 99/49901, WO 97/33552, WO 01/26693, and WO 01/70275, or by methods disclosed herein. The exemplary methods of the foregoing patents or references, or those described herein, may be applied generally to the various binding fusion proteins disclosed herein, resulting in the drug-binding fusion protein compositions, or to XTEN solely, resulting in the XTEN-D and/or BFP-D compositions of the invention.

Typically, attachment of a drug to a protein or other surface is accomplished using an activated drug derivative, that is to say, a drug having at least one activated terminus suitable for reaction with a nucleophilic center (e.g., lysine, cysteine and similar residues of proteins). Drug molecules having activated end groups suitable for reaction with the amino groups of proteins include those with functional groups such as aldehydes (Harris, J. M., Herati, R. S., Polym Prepr. (Am. Chem. Soc., Div. Polym. Chem), 32(1), 154-155 (1991), mixed anhydrides, N-hydroxysuccinimide esters, carbonylimadazolides, and chlorocyanurates (Herman, S., et al., Macromol. Chem. Phys. 195, 203-209 (1994)). Although many proteins have been shown to retain activity during modification, in some instances, drug attachment through protein amino groups can be undesirable, such as when derivatization of specific lysine residues inactivates the pharmacophore of the protein (Suzuki, T., et al., Biochimica et Biophysica Acta 788, 248-255 (1984)). Moreover, since many non-XTEN proteins possess several available/accessible amino groups, the resulting drug conjugates formed are typically mixtures of mono-, di-, tri-conjugated species and so on, which can be difficult and also time-consuming to characterize and separate. One method for avoiding these problems is to employ a site-selective reagent that targets functional groups other than amines One particularly attractive target is the thiol group, which in proteins in present in the amino acid, cysteine. Cysteines are typically less abundant in proteins than lysines, thus reducing the likelihood of protein deactivation upon conjugation to these thiol-containing amino acids. Moreover, conjugation to cysteine sites can often be carried out in a well-defined manner, leading to the formation of single species polymer-conjugates.

The thiol-reactive reagent may be a multifunctional cross-linker reagent, a drug-linker, a capture reagent, i.e. affinity moiety, label reagent (e.g. a biotin-linker reagent), a detection label (e.g. a fluorophore reagent), a solid phase immobilization reagent (e.g. SEPHAROSE™, polystyrene, or glass), or a drug-cross-linker intermediate. One example of a thiol-reactive reagent is N-ethyl maleimide (NEM). In an exemplary embodiment, reaction of a thiol-XTEN with a biotin-linker reagent provides a biotinylated thiol-XTEN by which the presence and reactivity of the engineered cysteine residue may be detected and measured. Reaction of a thiol-XTEN with a multifunctional cross-linker reagent provides a thiol-XTEN with a functionalized cross-linker that may be further reacted with a drug moiety reagent or other label. In one embodiment, reaction of a thiol-XTEN or a targeted thiol-XTEN with a drug-linker intermediate provides a thiol-XTEN drug conjugate or a targeted thiol-XTEN drug conjugate, respectively.

A variety of linkage chemistries can be used for conjugation, including commercially available homo- or hetero-bifunctional cross-linker compounds, according to methods known and available in the art, such as those described, for example, in Hermanson, Greg T., Bioconjugate Techniques, Academic Press, Inc., 1995, and Wong, Shan S., Chemistry. Suitable cross-linking agents for use in preparing the compositions of the disclosure are commercially available from companies like Sigma-Aldrich, or Thermo Fisher Scientific Inc. (Pierce Protein Research Products). Of particular utility are cross-linker components that are available in activated form and can be directly used for conjugation. Examples of useful cross-linking agents are imidoesters, active halogens, maleimide, pyridyl disulfide, and NHS-esters. Homobifunctional cross-linking agents have two identical reactive groups and are often used in a one step chemical cross-linking procedure. Examples are BS3 (a non-cleavable water-soluble DSS analog), BSOCOES (base-reversible), DMA (Dimethyl adipimidate-2HCl), DMP (Dimethyl pimelimidate-2HCl), DMS (Dimethyl suberimidate-2HCl), DSG (5-carbon analog of DSS), DSP (Lomant's reagent), DSS (non-cleavable), DST (cleavable by oxidizing agents), DTBP (Dimethyl 3,3'-dithiobispropionimidate-2HCl), DTSSP, EGS, Sulfo-EGS, THPP, TSAT, PMPI (N-[p-maleimidophenyl]isocyanate), DFDNB (1,5-Difluoro-2,4-dinitrobenzene) is especially useful for cross-linking between small spacial distances (Komblatt, J. A. and Lake, D. F. (1980). Cross-linking of cytochrome oxidase subunits with difluorodinitrobenzene. Can J. Biochem. 58, 219-224).

Sulfhydryl-reactive homobifunctional cross-linking agents are homobifunctional protein cross-linkers that react with sulfhydryls and are often based on maleimides and maleamic acid, which react with —SH groups, forming stable thioether linkages. The reaction can be conducted at a pH of from about 6 to about 10, and at, for example, a pH of about 6.0, 6.5, 7.0, 7.5, 8.0, 8.5, 9.0, 9.5, or 10, with optimal pH at about 6.5 to about 8. In embodiments based on maleimide cross-linkers, one can further increase the stability of conjugates the maleimide ring can be intentionally forced open by hydrolysis during the reaction using a pH of 7 to about 9 and reaction temperature of about 10° C. to 45° C., or about 18° C. to about 30° C., to provide conjugates where the maleimide component is converted to its more stable succinamic acid opened-ring form.

For drugs with conjugated maleimide cross-linkers, the method includes reacting the protein with an active agent that possesses a nucleophile under conditions effective to couple the drug-linker to the protein. An example of such a cross-linker and reaction include BM[PEO]3; an 8-atom polyether spacer that reduces potential for conjugate precipitation in sulfydryl-to-sulfhydryl cross-linking applications. BM[PEO]4 is similar but with an 11-atom spacer. BMB is a non-cleavable cross-linker with a four-carbon spacer. BMDB makes a linkage that can be cleaved with periodate. BMH is a widely used homobifunctional sulfhydryl-reactive cross-linker. BMOE has an especially short cross-linker. DPDPB and DTME are cleavable cross-linkers. HVBS does not have the hydrolysis potential of maleimides. TMEA is another option. Hetero-bifunctional cross-linking agents have two different reactive groups. Examples are NHS-esters and amines/hydrazines via EDC activation, AEDP, ASBA (photoreactive, iodinatable), EDC (water-soluble carbodiimide). Amine-Sulfhydryl reactive bifunctional cross-linkers are AMAS, APDP, BMPS, EMCA, EMCS, GMBS, KMUA, LC-SMCC, LC-SPDP, MBS, SBAP, SIA (extra short), SIAB, SMCC, SMPB, SMPH, SMPT, SPDP, Sulfo-EMCS, Sulfo-GMBS, Sulfo-KMUS, Sulfo-LC-SMPT, Sulfo-LC-SPDP, Sulfo-MBS, Sulfo-SIAB, Sulfo-SMCC, Sulfo-SMPB. Sulfhydryl-carbonyl reactive bifunctional cross linkers, such as KMUH(N-[k-Maleimidoundecanoic acid]hydrazide), BMPH(N-[β-Maleimidopropionic acid]hydrazide), EMCH ([N-e-Maleimidocaproic acid]hydrazide), MPBH (4-(4-N-Maleimidophenyl)butyric acid hydrazide hydrochloride), and PDPH (3-(2-Pyridyldithio)propionyl hydrazide). Amino-group reactive heterobifunctional cross-linking agents are ANB-NOS, MSA, NHS-ASA, SADP, SAED, SAND, SANPAH, SASD, SFAD, Sulfo-HSAB, Sulfo-NHS-LC-ASA, Sulfo-SADP, Sulfo-SANPAH, TFCS. Arginine-reactive cross-linking agents are, for example APG, which reacts specifically with arginines at pH 7-8.

For drugs with conjugated maleimide cross-linkers, the method includes reacting the protein with an active agent that possesses a nucleophile under conditions effective to couple the drug-linker to the Michael Addition Receptor protein via a Michael-type addition reaction to form a polymer-succinimide-linked protein-drug conjugate. A "Michael Addition Receptor", as one skilled in the art will understand, is a moiety capable of reacting with a nucleophilic reagent so as to undergo a nucleophilic addition reaction characteristic of a Michael Addition reaction. After the nucleophilic addition occurs, the Michael Addition Receptor moiety is referred to as a "Michael Addition Adduct." Typically, a Michael Addition is the nucleophilic addition of a carbanion or another nucleophile to an alpha, beta unsaturated carbonyl compound, such as a thioacid that is created by treating the cysteine residues of the engineered XTEN to obtain a thiol, then a thioacid. Alternatively, the epsilon amino groups of the lysine-engineered XTEN can be thioloated using thiolating reagents, for example, SPDP or iminothiolane, to create the Michael Addition Receptor. Such methods are known in the art (see, e.g., U.S. Pat. No. 5,708,146).

Functional groups on the drug to be conjugated can include carboxylic acid functional groups and chloroformate functional groups, which are useful reactive sites because they can react with epsilon amino groups of a lysine-engineered XTEN or a cross-linker to form an amide linkage. Also useful as a reactive site is a carbonate functional group, such as but not limited to p-nitrophenyl carbonate, which can react with an amino group to form a carbamate linkage. Where the drug is to be conjugated through a hydroxyl group to the XTEN, the hydroxyl end groups of the drug molecule must be modified and/or provided in activated form, i.e. with reactive functional groups (examples of which include primary amino groups, aminoxy, aldehyde, hydrazide (HZ), thiol, thiolate, succinate (SUC), succinimidyl succinate (SS), succinimidyl succinate "active ester", succinimidyl succinamide (SSA), succinimidyl propionate (SPA), succinimidyl butanoate (SBA), succinimidyl carboxymethylate (SCM), benzotriazole carbonate (BTC), N-hydroxysuccinimide (NHS), aldehyde, nitrophenylcarbonate (NPC), and tresylate (TRES)).

Other suitable reactive functional groups of drug molecules include acetal, aldehydes having a carbon length of 1 to 25 carbons (e.g., acetaldehyde, propionaldehyde, and butyraldehyde), aldehyde hydrate, alkenyl, acrylate, methacrylate, acrylamide, active sulfone, amine, hydrazide, thiol, alkanoic acids (e.g., carboxylic acid, carboxymethyl, propanoic acid, and butanoic acid), acid halide, isocyanate, isothiocyanate, maleimide, vinylsulfone, dithiopyridine, vinylpyridine, iodoacetamide, epoxide, glyoxal, dione, mesylate, tosylate, and tresylate.

The drug can also be conjugated using a heterocycle radical of a ring system. Heterocyclyl groups include a ring system in which one or more ring atoms is a heteroatom, e.g. nitrogen, oxygen, and sulfur. The heterocycle radical comprises 1 to 20 carbon atoms and 1 to 3 heteroatoms selected from N, O, P, and S. A heterocycle may be a monocycle having 3 to 7 ring members (2 to 6 carbon atoms and 1 to 3 heteroatoms selected from N, O, P, and S) or a bicycle having 7 to 10 ring members (4 to 9 carbon atoms and 1 to 3 heteroatoms selected from N, O, P, and S), for example: a bicyclo [4,5], [5,5], [5,6], or [6,6] system. Heterocycles are described in Paquette, Leo A.; "Principles of Modern Heterocyclic Chemistry" (W. A. Benjamin, New York, 1968); "The Chemistry of Heterocyclic Compounds", A series of Monographs" (John Wiley & Sons, New York, 1950 to present), in particular Volumes 13, 14, 16, 19, and 28; and J. Am. Chem. Soc. (1960) 82:5566. Examples of heterocycles that may be found in drugs suitable for conjugation include by way of example and not limitation pyridyl, dihydroypyridyl, tetrahydropyridyl (piperidyl), thiazolyl, tetrahydrothiophenyl, sulfur oxidized tetrahydrothiophenyl, pyrimidinyl, furanyl, thienyl, pyrrolyl, pyrazolyl, imidazolyl, tetrazolyl, benzofuranyl, thianaphthalenyl, indolyl, indolenyl, quinolinyl, isoquinolinyl, benzimidazolyl, piperidinyl, 4-piperidonyl, pyrrolidinyl, 2-pyrrolidonyl, pyrrolinyl, tetrahydrofuranyl, bis-tetrahydrofuranyl, tetrahydropyranyl, bis-tetrahydropyranyl, tetrahydroquinolinyl, tetrahydroisoquinolinyl, decahydroquinolinyl, octahydroisoquinolinyl, azocinyl, triazinyl, 6H-1,2,5-thiadiazinyl, 2H,6H-1,5,2-dithiazinyl, thienyl, thianthrenyl, pyranyl, isobenzofuranyl, chromenyl, xanthenyl, phenoxathinyl, 2H-pyrrolyl, isothiazolyl, isoxazolyl, pyrazinyl, pyridazinyl, indolizinyl, isoindolyl, 3H-indolyl, 1H-indazolyl, purinyl, 4H-quinolizinyl, phthalazinyl, naphthyridinyl, quinoxalinyl, quinazolinyl, cinnolinyl, pteridinyl, 4Ah-carbazolyl, carbazolyl, β-carbolinyl, phenanthridinyl, acridinyl, pyrimidinyl, phenanthrolinyl, phenazinyl, phenothiazinyl, furazanyl, phenoxazinyl, isochromanyl, chromanyl, imidazolidinyl, imidazolinyl, pyrazolidinyl, pyrazolinyl, piperazinyl, indolinyl, isoindolinyl, quinuclidinyl, morpholinyl, oxazolidinyl, benzotriazolyl, benzisoxazolyl, oxindolyl, benzoxazolinyl, and isatinoyl.

In some cases, the drug molecules are attached to the lysine- or cysteine engineered XTEN by cross-linkers having two reactive sites for binding to the drug and the XTEN. Preferred cross-inker groups are those that are relatively stable to hydrolysis in the circulation, are biodegradable and are nontoxic when cleaved from the conjugate. In addition, the use of cross-linkers can provide the potential for conjugates with an even greater flexibility between the drug and the XTEN, or provide sufficient space between the drug and the XTEN such that the XTEN does not interfere with the binding between the pharmacophore and its binding site. In one embodiment, a cross-linker has a reactive site that has an electrophilic group that is reactive to a nucleophilic group present on an XTEN. Preferred nucleophiles include thiol, thiolate, and amino. The heteroatom of the nucleophilic group of a lysine- or cysteine-engineered XTEN is reactive to an electrophilic group on a cross-linker and forms a covalent bond to the cross-linker unit. Useful electrophilic groups for cross-linkers include, but are not limited to, maleimide and haloacetamide groups, and provide a convenient site for attachment to the XTEN.

In another embodiment, a cross-linker has a reactive site that has a nucleophilic group that is reactive to an electrophilic group present on a drug. Useful electrophilic groups on a drug include, but are not limited to, hydroxyl, thiol, aldehyde and ketone carbonyl groups. The heteroatom of a nucleophilic group of a cross-linker can react with an electrophilic group on a drug and form a covalent bond. Useful nucleophilic groups on a cross-linker include, but are not limited to, hydrazide, oxime, amino, hydrazine, thiosemicarbazone, hydrazine carboxylate, and arylhydrazide. The electrophilic group on a drug provides a convenient site for attachment to a cross-inker.

For conjugation of drugs to the lysine epsilon amino group of lysine-engineered XTEN, use of reactive drug-N-hydroxylsuccinimide, or esters such as drug-succinimidyl propionate, or drug-succinimidyl butanoate or other drug-succinimide conjugates can be employed. Alternatively, lysine residues may be used to introduce free sulfhydryl groups through reaction with iminothiolane. Alternatively, targeting substance lysines may be linked to a heterobifunctional reagent having a free hydrazide or aldehyde group available for conjugation with an active agent. Reactive esters can couple at physiological pH, but less reactive derivatives typically require higher pH. Low temperatures may also be employed if a labile protein is being used. Under low temperature conditions, a longer reaction time may be used for the conjugation reaction.

Amino group conjugation with lysine residues is facilitated by the difference between the pKa values of the α-amino group of the N-terminal amino acid (approximately 7.6 to 8.0) and the ε-amino group of lysine (approximately 10). Conjugation of the terminal amino group often employs reactive drug-aldehydes (such as drug-propionaldehyde or drug-butylaldehyde), which are more selective for amines and thus are less likely to react with, for example, the imidazole group of histidine. In addition, lysinyl amino residues are reacted with succinic or other carboxylic acid anhydrides, or with N,N'-Disuccinimidyl carbonate (DSC), N,N'-carbonyl diimidazole (CDI), or p-nitrophenyl chloroformate to yield the activated succinimidyl carbonate, imidazole carbamate or p-nitrophenyl carbonate, respectively. Derivatization with these agents has the effect of reversing the charge of the lysinyl residues. Conjugation of a drug-aldehyde to the terminal amino group typically takes place in a suitable buffer performed at a pH which allows one to take advantage of the pKa differences between the ε-amino groups of the lysine residues and that of the α-amino group of the N-terminal residue of the protein; usually the pH for coupling lies in the range of from about pH 7 up to about 8. Useful methods for conjugation of the lysine epsilon amino group have been described in U.S. Pat. No. 4,904,584 and U.S. Pat. No. 6,048,720.

The person with ordinary skill in the art will be aware that the activation method and/or conjugation chemistry to be used depends on the reactive groups of the XTEN polypeptide as well as the functional groups of the drug moiety (e.g., being amino, hydroxyl, carboxyl, aldehyde, sulfhydryl, etc), the functional group of the drug-cross-linker reactant, or the functional group of the XTEN-cross-linker reactant. The drug conjugation may be directed towards conjugation to all available attachment groups on the engineered XTEN polypeptide such as the specific engineered attachment groups on the incorporated cysteine residues or lysine residues. In order to control the reactants such that the conjugation is directed to the appropriate reactive site, the invention contemplates the use of protective groups. A "protecting group" is a moiety that prevents or blocks reaction of a particular chemically reactive functional group in a molecule under certain reaction conditions. The protecting group will vary depending upon the type of chemically reactive group being protected as well as the reaction conditions to be employed, as well as the presence of additional reactive groups in the molecule. Non-limiting examples of functional groups which may be protected include carboxylic acid groups, hydroxyl groups, amino groups, hydroxyl groups, thiol groups, and carbonyl groups. Representative protecting groups for carboxylic acids and hydroxyls include esters (such as a p-methoxybenzyl ester), amides and hydrazides; for amino groups, carbamates (such as tert-butoxycarbonyl) and amides; for hydroxyl groups, ethers and esters; for thiol groups, thioethers and thioesters; for carbonyl groups, acetals and ketals; and the like. Such protecting groups are well-known to those skilled in the art and are described, for example, in T. W. Greene and G. M. Wuts, *Protecting Groups in Organic Synthesis, Third Edition*, Wiley, New York, 1999, and references cited therein.

The conjugation may be achieved in one step or in a step-wise manner (e.g., as described in WO 99/55377), such as through addition of a reaction intermediate cross-linker, using the cross-linkers disclosed herein or those known in the art to be useful for conjugation to cysteine or lysine residues of polypeptides to be linked to reactive functional groups on drug molecules.

In some cases, the method for conjugating a cross-linker to a cysteine-engineered XTEN may provide that the XTEN is pre-treated with a reducing agent, such as dithiothreitol (DTT) to reduce any cysteine disulfide residues to form highly nucleophilic cysteine thiol groups ($-CH_2SH$). The reducing agent is subsequently removed by any conventional method, such as by desalting. The partially reduced XTEN thus reacts with drug-linker compounds, or cross-linker reagents, with electrophilic functional groups such as maleimide or α-halo carbonyl, according to, for example, the conjugation method of Klussman, et al. (2004), Bioconjugate Chemistry 15(4):765-773. Conjugation of a cross-linker or a drug to a cysteine residue typically takes place in a suitable buffer at pH 6-9 at temperatures varying from 4° C. to 25° C. for periods up to about 16 hours. Alternatively, the cysteine residues can be derivatized with an organic derivatizing agent. Suitable derivatizing agents and methods are well known in the art. For example, cysteinyl residues most commonly are reacted with α-haloacetates (and corresponding amines), such as chloroacetic acid or chloroacetamide, to give carboxymethyl or carboxyamidomethyl derivatives. Cysteinyl residues also are derivatized by reaction with bromotrifluoroacetone, α-bromo-β-(4-imidozoyl)propionic acid, chloroacetyl phosphate, N-alkylmaleimides, 3-nitro-2-pyridyl disulfide, methyl 2-pyridyl disulfide, p-chloromercuribenzoate, 2-chloromercuri-4-nitrophenol, or chloro-7-nitrobenzo-2-oxa-1,3-diazole.

In one embodiment, XTEN can be dissolved in 500 mM sodium borate and 500 mM sodium chloride at pH 8.0 and then is treated with an excess of 100 mM dithiothreitol (DTT). After incubation at 37° C. for about 30 minutes, the buffer is exchanged by elution over Sephadex G25 resin and eluted with PBS with 1 mM DTPA. The thiol/XTEN value is checked by determining the reduced XTEN concentration from the absorbance at 280 nm of the solution and the thiol concentration by reaction with DTNB (Aldrich, Milwaukee, Wis.) and determination of the absorbance at 412 nm. The reduced XTEN dissolved in PBS is chilled on ice. The drug cross-linker, e.g., MC-val-cit-PAB-MMAE in DMSO, dissolved in acetonitrile and water at known concentration, is added to the chilled reduced XTEN in PBS. After about one hour, an excess of maleimide is added to quench the reaction and cap any unreacted antibody thiol groups. The reaction mixture is concentrated by centrifugal ultrafiltration and the XTEN-MC-vc-PAB-MMAE, is purified and desalted by elution through G25 resin in PBS, filtered through 0.2 μm filters under sterile conditions, and held under suitable storage conditions.

Such an approach may used to conjugate other thiol-reactive agents to the cysteine of the XTEN, in which the reactive group is, for example, a maleimide, an iodoacetamide, a pyridyl disulfide, or other thiol-reactive conjugation partner linked to a drug partner (Haugland, 2003, Molecular Probes Handbook of Fluorescent Probes and Research Chemicals, Molecular Probes, Inc.; Brinkley, 1992, Bioconjugate Chem. 3:2; Garman, 1997, Non-Radioactive Labelling: A Practical Approach, Academic Press, London; Means (1990) Bioconjugate Chem. 1:2; Hermanson, G. in Bioconjugate Techniques (1996) Academic Press, San Diego, pp. 40-55, 643-671). Maleimides in particular are useful in cross-linking due to their susceptibility to additions across the double bond either by Michael additions or via Diels-Alder reactions. Bismaleimides are a class of maleimide compounds with two maleimide groups connected through a molecular unit and can be used as cross-linking reagents.

In some instances, the conjugation is performed under conditions aiming at reacting as many of the available XTEN attachment groups as possible with drug or drug-linker molecules. This is achieved by means of a suitable molar excess of the drug in relation to the polypeptide. Typical molar ratios of activated drug or drug-linker molecules to polypeptide are up to about 1000-1, such as up to about 200-1 or up to about 100-1. In some cases, the ratio may be somewhat lower, however, such as up to about 50-1, 10-1 or 5-1. Also equimolar ratios may be used.

In some case, the drug-containing conjugate compositions of the disclosure retain at least a portion of the pharmacologic activity compared to the corresponding unconjugated drug. In one embodiment, the drug conjugate retains at least about 1%, or at least about 5%, or at least about 10%, or at least about 20%, or at least about 30%, or at least about 40%, or at least about 50%, or at least about 60%, or at least about 70%, or at least about 80%, or at least about 90%, or at least about 95% of the pharmacologic activity of the unconjugated drug.

In other cases, the drug may be derivatized through a reactive functional group that is important for the biological activity of the drug thereby inhibiting or reducing the pharmacological activity of the drug to thereby convert the drug into a pharmacologically inactive or relatively inactive peptidyl derivative conjugate. In one embodiment, the prodrug cross-linker contains a peptide residue specifically tailored so as to render a drug conjugate of the present invention a selective substrate susceptible to enzymatic cleavage by one or more proteases, e.g., preferably lysosomal proteases, such as cathepsin B, C or D. The enzymatic cleavage reaction will remove the prodrug cross-linker from the drug moiety and affect the release of the drug in its pharmacologically active form. Representative hydrolytically degradable linkages in a cross-linker-drug conjugate include carboxylate ester, carbonate ester, phosphate ester, anhydride, acetal, ketal, acyloxyalkyl ether, imine, orthoester, and oligonucleotides. Esters such as carboxylate and carbonate esters are particularly preferred linkages. The particular linkage and linkage chemistry employed will depend upon the particular active agent, the presence of target and additional functional groups within the active agent, and the like; considerations that are within the knowledge of one skilled in the art. By such an approach, the inventive XTEN-drug and binding fusion protein-drug conjugate compositions administered to a subject may exhibit reduced toxicity or frequency of side effects compared to the corresponding free drug administered to a subject. Thus, the reduced toxicity of the XTEN-drug and binding fusion protein-drug conjugate compositions disclosed herein may permit the administration of higher amounts of drug, on a molar basis, compared to unconjugated drug.

The invention contemplates that the engineered XTEN, which incorporate either cysteine or lysine residues, may be conjugated with any drug moiety with a reactive functional group that can be covalently attached to the XTEN through a reactive cysteine thiol or epsilon amino group, respectively, either directly or by using a cross-linker, as described above. In another embodiment, the invention provides BFP-D compositions in which the drug can be conjugated to the targeting moiety of the binding protein component by conjugation to existing or incorporated cysteine or lysine residues, as well as N-terminal amino groups or C-terminal carboxyl groups that may be present.

(h) Release of Drug

The invention provides BFP-D and XTEN-drug compositions in which the drug can be released from the composition by either specific or non-specific mechanisms. In some cases, the drugs can be released by proteolytic degradation of those molecules taken up by cells. In one embodiment, the XTEN portion of the BFP-D or XTEN-drug is rapidly degraded by intracellular proteases, releasing the drug from the XTEN carrier. In other cases, the drug can be released by degradation of a cross-linker selected for inclusion into the BFP-D and XTEN-drug compositions based on its susceptibility to degradation. For example, it is known in the art that use of mild acid-cleavable linkers can promote drug release based on the observation that the pH inside tumors was often lower than normal physiological pH. In a non-limiting example, release of the conjugated drug component could be enhanced by incorporating a hydrazone as a cleavable unit and attaching a drug like doxorubicin to the protein component (either XTEN or the targeting moiety) via a thioether group, as described by Willner et al., U.S. Pat. No. 5,708,146; and Trail et al. Cure of xenografted human carcinomas by BR96-doxorubicin immunoconjugates. *Science* 261:212-215 (1993). In other cases, certain ester linkages can be incorporated into the linker between a protein and the drug that are labile; some by enzymes. (Gillimard and Saragovi, *Cancer Res.* 61:694-699 (2001)). Other examples of enzymatically susceptible linkages include urethane or carbonate-containing linkages. In addition, hydrolytically unstable linkages include carboxylate ester, phosphate ester, anhydrides, acetals, ketals, acyloxyalkyl ether, imines, orthoesters, peptides and oligonucleotides. Based upon these characteristics, it is believed that the drug ligand will be released rapidly after cellular internalization of the BFP-D or XTEN-drug conjugates.

(i) Configurations of BFP-D and XTEN-Drug Compositions

The invention provides binding fusion protein-drug conjugates and XTEN-drug conjugates in various configurations.

In one embodiment, the invention provides a binding fusion protein-drug conjugate composition of formula V:

$$[(D-CL)_{z1}\text{-}XTEN]_x\text{-}TM\text{-}[XTEN\text{-}(CL\text{-}D)_{z2}]_y \qquad V$$

wherein independently for each occurrence: x is either 0 or 1; y is either 0 or 1; XTEN is a cysteine- or lysine-engineered extended recombinant polypeptide as described above; TM is a targeting moiety with binding affinity to a target ligand selected from Table 1 or Table 2 (which may comprise more than one binding domain joined by linkers); CL is a cross-linker as defined herein; D is a drug moiety selected from Table 9 or a pharmaceutically acceptable salt, acid or derivative thereof; and z1 and z2 each independently is an integer from 1 to 100. The number of drug moieties that may be conjugated via a reactive cross-linker to an engineered XTEN molecule is limited by the number of reactive residues that are incorporated into the XTEN. Exemplary binding fusion protein-drug conjugate compositions of Formula V can comprise XTEN that have from 1 to about 100 cysteine or lysine engineered amino acids, or from 1 to about 50 cysteine or lysine engineered amino acids, or from 1 to about 40 cysteine or lysine engineered amino acids, or from 1 to about 20 cysteine or lysine engineered amino acids, or from 1 to about 10 cysteine or lysine engineered amino acids, or from 1 to about 5 cysteine or lysine engineered amino acids that are available for conjugation to drug molecules. In some cases, the binding fusion protein-drug conjugate retains at least about 1%, or at least about 5%, or at least about 10%, or at least about 20%, or at least about 30%, or at least about 40%, or at least about 50%, or at least about 60%, or at least about 70%, or at least about 80%, or at least about 90%, or at least about 95% of the pharmacologic activity of the unconjugated drug.

In another embodiment, the invention provides a binding fusion protein-drug conjugate composition of formula VI:

$$[(D-CL)_{z1}\text{-}XTEN]_x\text{-}TM1\text{-}L\text{-}TM2\text{-}[XTEN\text{-}(CL\text{-}D)_{z2}]_y \qquad VI$$

wherein independently for each occurrence: x is either 0 or 1, and y is either 0 or 1; XTEN is a either a cysteine- or lysine-engineered extended recombinant polypeptide as described; TM1 is a targeting moiety with binding affinity to a target ligand selected from Table 1 or Table 2 (which may comprise more than one binding domain joined by linkers); TM2 is a targeting moiety with binding affinity to a target ligand selected from Table 1 or Table 2 (which may comprise more than one binding domain joined by linkers) that may be identical or may be different to TM1; and L is a linker sequence having between 1 to about 300 amino acid residues wherein the linker sequence is covalently bound to the C terminus of TM1 and the N terminus of TM2; D is a drug moiety selected from Table 9 or a pharmaceutically acceptable salt, acid or derivative thereof; CL is a cross-linker as defined herein; and z1 and z2 each independently is an integer from 0 to 100. Exemplary binding fusion protein-drug conjugate compositions of Formula VI can comprise XTEN that have from 1 to about 100 cysteine or lysine engineered amino acids, or from 1 to about 50 cysteine or lysine engineered amino acids, or from 1 to about 40 cysteine or lysine engineered amino acids, or from 1 to about 20 cysteine or lysine engineered amino acids, or from 1 to about 10 cysteine or lysine engineered amino acids, or from 1 to about 5 cysteine or lysine engineered amino acids that are available for conjugation to drug molecules. In addition, the invention contemplates additional compositions comprising multiple targeting moieties and XTEN in various permutations of configurations. In some cases, the binding fusion protein-drug conjugate retains at least about 1%, or at least about 5%, or at least about 10%, or at least about 20%, or at least about 30%, or at least about 40%, or at least about 50%, or at least about 60%, or at least about 70%, or at least about 80%, or at least about 90%, or at least about 95% of the pharmacologic activity of the unconjugated drug.

In another embodiment, the invention provides a pharmacologically active XTEN-drug conjugate composition of formula VII:

$$(CL\text{-}D)_z\text{-}XTEN \qquad VII$$

wherein independently for each occurrence: XTEN is a either a cysteine- or lysine-engineered extended recombinant polypeptide as described above; D is a drug moiety selected from Table 9 or a pharmaceutically acceptable salt, acid or derivative thereof; CL is a cross-linker as defined herein; and z is an integer from 1 to 100. Exemplary XTEN-drug conjugate compositions of formula VII can comprise XTEN that have from 1 to about 100 cysteine or lysine engineered amino acids, or from 1 to about 50 cysteine or lysine engineered amino acids, or from 1 to about 40 cysteine or lysine engineered amino acids, or from 1 to about 20 cysteine or lysine engineered amino acids, or from 1 to about 10 cysteine or lysine engineered amino acids, or from 1 to about 5 cysteine or lysine engineered amino acids that are available for conjugation to drug molecules. In some cases, the XTEN-drug conjugate retains at least about 1%, or at least about 5%, or at least about 10%, or at least about 20%, or at least about 30%, or at least about 40%, or at least about 50%, or at least about 60%, or at least about 70%, or at least about 80%, or at least about 90%, or at least about 95% of the pharmacologic activity of the unconjugated drug.

In another embodiment, the invention provides a pharmacologically active XTEN-drug conjugate composition of formula VIII:

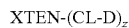

XTEN-(CL-D)$_z$  VIII wherein independently for each occurrence: XTEN is a either a cysteine- or lysine-engineered extended recombinant polypeptide as described above; D is a drug moiety selected from Table 9 or a pharmaceutically acceptable salt, acid or derivative thereof; CL is a cross-linker as defined herein; and z is an integer from 1 to 100. Exemplary XTEN-drug conjugate compositions of formula VII can comprise XTEN that have from 1 to about 100 cysteine or lysine engineered amino acids, or from 1 to about 50 cysteine or lysine engineered amino acids, or from 1 to about 40 cysteine or lysine engineered amino acids, or from 1 to about 20 cysteine or lysine engineered amino acids, or from 1 to about 10 cysteine or lysine engineered amino acids, or from 1 to about 5 cysteine or lysine engineered amino acids that are available for conjugation to drug molecules. In some cases, the XTEN-drug conjugate retains at least about 1%, or at least about 5%, or at least about 10%, or at least about 20%, or at least about 30%, or at least about 40%, or at least about 50%, or at least about 60%, or at least about 70%, or at least about 80%, or at least about 90%, or at least about 95% of the pharmacologic activity of the unconjugated drug.

The invention contemplates that the BFP-D encompass compositions in which the targeting moiety component(s) of the subject compositions can be directed to any of the specific targets described herein, including a target selected from Table 1 or Table 2, the drug conjugated to the composition can be any of the drugs of Table 9 or a pharmaceutically acceptable salt, acid or derivative thereof, and the XTEN component(s) can be cysteine- or lysine-engineered XTEN derived from or exhibiting substantial sequence identity to any of the XTEN of Table 4 or a fragment or variant thereof, and has cross-linker components that link the drug molecule(s) to the protein component. In an embodiment of the foregoing, the BFP-D composition can have one or more engineered-XTENs in which the XTEN has about 80% sequence identity to a XTEN selected from Table 4, or alternatively 81%, 82%, 83%, 84%, 85%, 86%, 87%, 88%, 89%, 90%, 91%, 92%, 93%, 94%, 95%, 96%, 97%, 98%, or 99% sequence identity to an XTEN selected from Table 4 and comprises one or more cysteine residues. In another embodiment of the foregoing, the BFP-D composition can have one or more engineered-XTENs in which the XTEN has about 80% sequence identity to a XTEN selected from Table 4, or alternatively 81%, 82%, 83%, 84%, 85%, 86%, 87%, 88%, 89%, 90%, 91%, 92%, 93%, 94%, 95%, 96%, 97%, 98%, or about 99% sequence identity to an XTEN selected from Table 4 and comprises one or more lysine residues. In any of the embodiments hereinabove described in this paragraph, the engineered XTEN can exhibit about 80% sequence identity to a XTEN selected from Table 8, or alternatively 81%, 82%, 83%, 84%, 85%, 86%, 87%, 88%, 89%, 90%, 91%, 92%, 93%, 94%, 95%, 96%, 97%, 98%, 99%, or exhibit 100% sequence identity to an XTEN selected from Table 8.

In an exemplary embodiment of a BFP-D, the binding fusion protein-drug composition comprises one or more anti-HER2 targeting moieties, an engineered XTEN, and one or more molecules of paclitaxel linked to the XTEN by a cross-linker. In another embodiment, the binding fusion protein-drug composition comprises one or more anti-HER2 targeting moieties, an engineered XTEN, and one or more molecules of docetaxel linked to the XTEN by a cross-linker. In another embodiment, the binding fusion protein-drug composition comprises one or more anti-HER2 targeting moieties, an engineered XTEN, and one or more molecules of irinotecan linked to the XTEN by a cross-linker. In any of the foregoing embodiments of the paragraph, the invention encompasses compositions that can be configured according to formula V or formula VI.

In an exemplary embodiment of an XTEN-D, the XTEN-drug composition comprises an engineered XTEN and one or more molecules of paclitaxel linked to the XTEN by a cross-linker. In another embodiment, the XTEN-drug composition comprises an engineered XTEN and one or more molecules of docetaxel linked to the XTEN by a cross-linker. In another embodiment, the XTEN-drug composition comprises an engineered XTEN and one or more molecules of irinotecan linked to the XTEN by a cross-linker. In any of the foregoing embodiments of the paragraph, the invention encompasses compositions that can be configured according to formula VI or formula VII.

Generally, binding fusion protein-drug conjugate compositions of the invention retain the antigen binding capability of their targeting moiety. In some cases, wherein the drugs are restricted to the XTEN carrier portion of the fusion protein, steric hindrance between the drug moiety, targeting moiety, and the target antigen or ligand is reduced. Thus, in preferred embodiments, engineered binding fusion protein-drug conjugates are capable of binding, preferably specifically, to target antigens and delivering the drug to the target location. Such antigens include, for example, tumor-associated antigens (TAA), cell surface receptor proteins and other cell surface molecules, transmembrane proteins, signaling proteins, cell survival regulatory factors, cell proliferation regulatory factors, molecules associated with tissue development or differentiation, lymphokines, cytokines, molecules involved in cell cycle regulation, molecules involved in vasculogenesis or angiogenesis. An antigen to which an engineered binding fusion protein-drug composition is capable of binding may be a member of a subset of one of the above-mentioned categories, wherein the other subset(s) of said category comprise other molecules/antigens that have a distinct characteristic (with respect to the antigen of interest).

The invention also contemplates that the XTEN-drug encompass compositions in which the drug conjugated to the XTEN can be any of the drugs of Table 9 or a pharmaceutically acceptable salt, acid or derivative thereof, and the XTEN component can be cysteine- or lysine-engineered XTEN derived from or exhibiting substantial sequence identity to any of the XTEN of Table 4 or a fragment or variant thereof, and has cross-linker components that link the drug molecule(s) to the XTEN component. In an embodiment of the foregoing, the XTEN-drug composition can have an engineered-XTENs in which the XTEN has about 80% sequence identity to a XTEN selected from Table 4, or alternatively 81%, 82%, 83%, 84%, 85%, 86%, 87%, 88%, 89%, 90%, 91%, 92%, 93%, 94%, 95%, 96%, 97%, 98%, or about 99% sequence identity to an XTEN selected from Table 4 and comprises one or more cysteine residues. In another embodiment of the foregoing, the XTEN-drug composition can have an engineered-XTEN in which the XTEN has about 80% sequence identity to a XTEN selected from Table 4, or alternatively 81%, 82%, 83%, 84%, 85%, 86%, 87%, 88%, 89%, 90%, 91%, 92%, 93%, 94%, 95%, 96%, 97%, 98%, or about 99% sequence identity to an XTEN selected from Table 4 and comprises one or more lysine residues. In some cases, the XTEN-drug encompass compositions in which the drug conjugated to the XTEN can be any of the drugs of Table 9 or a pharmaceutically acceptable salt, acid or derivative thereof, and the XTEN component can be cysteine- or lysine-engineered XTEN derived from or exhibiting substantial sequence identity to any of the engineered XTEN of Table 8 or a fragment or variant thereof, and has cross-linker components that link the drug molecule(s) to the cysteine or lysine residues of the XTEN component. In one embodiment of the foregoing, the engineered XTEN can exhibit about 80% sequence identity to a XTEN selected from Table 8, or alternatively 81%, 82%, 83%, 84%, 85%, 86%, 87%, 88%, 89%, 90%, 91%, 92%, 93%, 94%, 95%, 96%, 97%, 98%, 99%, or exhibits 100% sequence identity to an XTEN selected from Table 8.

(j) Methods of Use of BFP-Drug and XTEN-Drug Compositions

In another aspect, the invention provides a method for achieving a beneficial effect in a disease, disorder or condition mediated by a BFP-D or XTEN-drug composition. In one embodiment, the invention provides the use of a BFP-D, in which the targeting moiety of the binding fusion protein is derived from a parental antibody that binds to a target selected from the group consisting of the targets of Table 1 or Table 2 and the drug is selected from Table 9, in treatment of a disease, disorder or condition to a subject in need thereof by administration of a therapeutically effective amount of the BFP-D, wherein said administration leads to the eradication or amelioration of one or more of the physiological or clinical symptoms associated with the underlying disorder such that an improvement is observed in the subject, notwithstanding that the subject may still be afflicted with the underlying disorder. In another embodiment, the invention provides a method of treating a disease, disorder, or condition in a mammal comprising administering to the mammal a therapeutically effective amount of a BFP-D comprising one or more targeting moieties directed to one or more targets selected from Table 1 or Table 2, linked to one or more XTEN sequences molecules and, optionally, one or more linkers, to form the binding fusion protein component, wherein the linkage does not substantially alter the essential functional properties of binding affinity and sustained terminal half-life or reduced serum clearance rate as compared to that of the parental targeting moiety from which the binding fusion protein component is derived and wherein the drug conjugated to the BFP-D is selected from Table 9, wherein the administration of the BFP-D to a subject in need thereof achieves a beneficial therapeutic effect. The effective amount can produce a beneficial effect in helping to treat (e.g., cure or reduce the severity) or prevent (e.g., reduce the likelihood of onset or severity) a disease, disorder or condition, such as, but not limited to a cancer, a cardiovascular disease or condition, an infectious disease, an inflammatory condition, a respiratory condition, organ transplant rejection, or a metabolic disease mediated by or associated with one or more targets selected from Table 1 or Table 2.

The incorporation of a drug into the inventive fusion proteins provides enhanced compositions that can result in the cure, mitigation, treatment, or prevention of diseases, disorders or conditions in man or other animals. The drug conjugates as represented by formula V or formula VI or formula VII or formula VIII of the present invention are effective for the usual purposes for which the corresponding drugs are effective. In one embodiment, the BFP-D compositions can have superior efficacy compared to the unconjugated drug because of the ability, inherent in the target moiety, to transport the drug to the desired cells where it is of particular benefit. Exemplary embodiments of the foregoing and representative data are provided in the Examples, below. In another embodiment, the BFP-D and XTEN-drug compositions can have superior efficacy compared to the unconjugated drug because of enhanced terminal half-life conferred by the XTEN carrier. In another embodiment, the invention provides BFP-D and XTEN-drug compositions that can have superior efficacy, an enhanced pharmacologic response, and/or reduced toxicity compared to the unconjugated drug because of the differential compartmentalization of the composition compared to the unconjugated drug; e.g., lack of penetration across the blood-brain barrier, nerve barriers, or cytoplasmic barriers of non-targeted cells. Exemplary embodiments of the foregoing and representative data are provided in the Examples, below. In a particular advantage of the inventive compositions, such enhanced properties permit lower-dose pharmaceutical formulations or treatment methods using a reduced dosage or dose regimen, both because of targeted delivery to tissues and cells and because of enhanced pharmacokinetic properties, resulting in a superior therapeutic index; i.e., improved efficacy with reduced toxicity. The invention provides for methods of using the conjugate compositions in therapeutic and diagnostic methods, for example for tumor targeting therapeutics having an altered rate of uptake or tissue diffusion as compared with the active drug alone.

In one embodiment, the method comprises administering a therapeutically-effective amount of a pharmaceutical composition comprising a BFP-D comprising one or more targeting moieties linked to one or more XTEN sequence(s) and at least one pharmaceutically acceptable carrier to a subject in need thereof that results in an improvement in at least one parameter, physiologic condition, or clinical outcome mediated by the targeting moiety component(s). In another embodiment, the method comprises administering a therapeutically-effective amount of a pharmaceutical composition comprising a drug, such as but not limited to a drug selected from Table 9, linked to an XTEN sequence and at least one pharmaceutically acceptable carrier to a subject in need thereof that results in an improvement in at least one parameter, physiologic condition, or clinical outcome mediated by the targeting moiety component(s). The methods contemplate administration of the pharmaceutical composition by any route appropriate for the disease, disorder or condition being treated, including subcutaneously, intramuscularly, intravitreally, or intravenously.

The methods of the invention may include administration of consecutive doses of a therapeutically effective amount of the pharmaceutical composition for a period of time sufficient to achieve and/or maintain the desired parameter or clinical effect, and such consecutive doses of a therapeutically effective amount establishes the therapeutically effective dose regimen for the pharmaceutical composition; i.e., the schedule for consecutively administered doses, wherein the doses are given in therapeutically effective amounts to result in a sustained beneficial effect on any clinical sign or symptom, aspect, measured parameter or characteristic of a metabolic disease state or condition, including, but not limited to, those described herein.

A therapeutically effective amount of the pharmaceutical composition may vary according to factors such as the disease state, age, sex, and weight of the individual, and the ability of the antibody or antibody portion to elicit a desired response in the individual. A therapeutically effective amount is also one in which any toxic or detrimental effects of the binding fusion protein are outweighed by the therapeutically beneficial effects. A prophylactically effective amount refers to an amount of pharmaceutical composition required for the period of time necessary to achieve the desired prophylactic result.

For the inventive methods, longer acting BFP-D or XTEN-drug compositions or pharmaceutical compositions comprising the BFP-D or XTEN-drug compositions are preferred, so as to improve patient convenience, to increase the interval between doses and to reduce the amount of drug required to achieve a sustained effect. In one embodiment, a method of treatment comprises administration of a therapeutically effective dose of a BFP-D or an XTEN-drug to a subject in need thereof that results in a gain in time spent within a therapeutic window established for the targeting moiety or drug components of the pharmaceutical composition compared to the corresponding drug component not linked to the fusion protein and administered at a comparable dose to a subject. In some cases, the gain in time spent within the therapeutic window is at least about three-fold, or at least about four-fold, or at least about five-fold, or at least about six-fold, or at least about eight-fold, or at least about 10-fold, or at least about 20-fold, or at least about 40-fold compared to the corresponding targeting moiety or drug components not linked to the fusion protein and administered at a comparable dose to a subject. The methods further provide that administration of multiple consecutive doses of a pharmaceutical composition administered using a therapeutically effective dose regimen to a subject in need thereof can result in a gain in time between consecutive $C_{max}$ peaks and/or $C_{min}$ troughs for blood levels of the composition compared to the corresponding targeting moiety or drug components not linked to the fusion protein. In the foregoing embodiment, the gain in time spent between consecutive $C_{max}$ peaks and/or $C_{min}$ troughs can be at least about three-fold, or at least about four-fold, or at least about five-fold, or at least about six-fold, or at least about eight-fold, or at least about 10-fold, or at least about 20-fold, or at least about 40-fold compared to the corresponding drug component(s) not linked to the fusion protein and administered using a comparable dose regimen established for that drug. In the embodiments hereinabove described in this paragraph the administration of the fusion protein or pharmaceutical composition can result in an improvement in at least one parameter known to be useful for assessing the subject diseases, conditions or disorders) using a lower unit dose in moles of fusion protein compared to the corresponding targeting moiety component(s) or the drug component(s) not linked to the fusion protein and administered at a comparable unit dose or dose regimen to a subject.

In one embodiment, the administration of a BFP-D or XTEN-drug pharmaceutical composition can result in an improvement in one of the clinical, biochemical or physiologic parameters that is greater than that achieved by administration of the targeting moiety or drug components not linked to XTEN, determined using the same assay or based on a measured clinical parameter. In another embodiment, administration of the BFP-D or XTEN-drug pharmaceutical composition can result in improvement two or more clinical or metabolic-related parameters, each mediated by one of the different targeting moieties that collectively result in an enhanced effect compared the targeting moiety component not linked to XTEN, determined using the same assays or based on measured clinical parameters. In another embodiment, administration of the binding fusion protein or pharmaceutical composition can result in activity in one or more of the clinical or biochemical or physiologic parameters that is of longer duration than the activity of one of the single targeting moiety or drug components not linked to XTEN, determined using that same assay or based on a measured clinical parameter.

The subject BFP-D or XTEN-drug conjugate compositions may be useful in the treatment of various diseases, disorders and conditions. In one embodiment, the disease is cancer, including carcinomas/tumors, melanomas, sarcomas, leukemias and lymphomas, and gliomas. Exemplary conditions or hyperproliferative disorders include benign or malignant tumors, neuronal, glial, astrocytal, hypothalamic, glandular, macrophagal, epithelial, stromal, blastocoelic, inflammatory, angiogenic and immunologic, including autoimmune, disorders. One or more compositions of the invention may be used in a combination with another treatment or drug to treat a patient. As used herein, a "patient" refers to any mammal, including a human, and may be afflicted with any disease, disorder or condition that may be effectively treated with a therapeutic antibody or a drug, including diseases, disorders or conditions associated with the targets of Tables 1 or 2 or diseases, disorders or conditions conventionally treated with the drugs of Table 9. Treatment with a conjugate may be a primary treatment for a disease or a disorder, or it may be adjuvant therapy for a disease or disorder. Furthermore, the treatment may be of an existing disease or may be prophylactic. Appropriate dosages and dose schedules for the inventive compositions may generally be determined using experimental models and/or clinical trials. The use of the minimum dosage that is sufficient to provide effective therapy may be preferred in some circumstances, such as when the drug is associated with harmful side effects. Patients may generally be monitored for therapeutic or prophylactic effectiveness using assays suitable for the condition being treated or prevented, which will be familiar to those having ordinary skill in the art. Such methods will permit the establishment of the therapeutic window as well as the maximum tolerated dose for the compositions of the invention.

The XTEN-drug compositions and/or the binding fusion protein-drug compositions and pharmaceutical compositions comprising the BFP-D or XTEN-D can be administered by routes and by methods and dosing schedules appropriate for the given disease, disorder or condition. In certain embodiments, the XTEN-drug compositions and/or the binding fusion protein-drug compositions of the invention are administered as an IV infusion. In other embodiments, the compositions are administered subcutaneously or intramuscularly. In yet other embodiments, the compositions are administered orally. In the case of intravenous infusion, administration may last for any appropriate time period, which is readily determinable and assessable by one of ordinary skill in the art. For example, infusions may last for from about one to about 24 hours, although shorter or longer infusion times all fall within the scope of the invention. In certain embodiments, infusions are administered daily, weekly, every two weeks, every 21 days, or monthly. Appropriate time periods are known by one of skill in the art, and may be determined based upon a variety of factors, including the type of therapy or drug being used in combination with the XTEN-drug conjugate. Clinicians of ordinary skill in the art of medicine will know that the dosage that is administered to a patient will vary according to the age, weight and physical condition of the patient, the route of administration, the specific disease being treated, the stage of disease and the like. For any particular subject, the specific dosage regimens (both dosage and frequency of administration) should be adjusted for that patient by a skilled practitioner. Examples of different ranges of dosage and administration schedules are provided in U.S. Pat. No. 5,670,537.

Targeted XTEN-drug conjugate compositions useful in the treatment of cancer include, but are not limited to, compositions comprising one or more targeting moieties against cell surface receptors and tumor-associated antigens (TAA). Tumor-associated antigens are known in the art, and can be prepared for use in generating targeting moieties using methods and information that are well known in the art. Non-limiting examples of tumor-associated polypeptides are contained within Table 2. In preferred embodiments, the targets to which targeting moieties would be directed could include receptors specifically expressed on the surface of one or more particular type(s) of cancer cell as compared to on one or more normal non-cancerous cells. Often, such tumor-associated polypeptides are more abundantly expressed on the surface of the cancer cells as compared to on the surface of the non-cancerous cells; e.g., HER2 in certain breast cancers. The identification of such tumor-associated cell surface antigen polypeptides has given rise to the ability to specifically target cancer cells for destruction via antibody-based therapies.

Disorders Mediated by VEGF-Expressing Cells

A BFP-D composition that comprises a targeting moiety derived from an anti-VEGF antibody or fragment can be advantageously utilized in a method of treating a VEGF-mediated disease or disorder, such as neovascular disorders. In one embodiment, the invention provides a method of treating a solid tumor disorder in a human patient comprising administering to the patient an effective amount of a BFP-D or pharmaceutical composition wherein at least one targeting moiety in the binding fusion protein comprises an antigen binding site that binds to human VEGF wherein the binding can inhibit vascularization of the tumor, and the BFP-D further comprises a conjugated cytotoxic drug, such as a drug selected from Table 9, for treating a solid tumor. In yet another embodiment, the solid tumor disorder in the foregoing method is selected from the group consisting of breast carcinomas, lung carcinomas, gastric carcinomas, esophageal carcinomas, colorectal carcinomas, liver carcinomas, ovarian carcinomas, thecomas, arrhenoblastomas, cervical carcinomas, endometrial carcinoma, endometrial hyperplasia, endometriosis, fibrosarcomas, choriocarcinoma, head and neck cancer, nasopharyngeal carcinoma, laryngeal carcinomas, hepatoblastoma, Kaposi's sarcoma, melanoma, skin carcinomas, hemangioma, cavernous hemangioma, hemangioblastoma, pancreas carcinomas, retinoblastoma, astrocytoma, glioblastoma, Schwannoma, oligodendroglioma, medulloblastoma, neuroblastomas, rhabdomyosarcoma, osteogenic sarcoma, leiomyosarcomas, urinary tract carcinomas, thyroid carcinomas, Wilm's tumor, renal cell carcinoma, prostate carcinoma, abnormal vascular proliferation associated with phakomatoses, edema (such as that associated with brain tumors), and Meigs' syndrome.

In still another embodiment, the invention provides a method of treating an intraocular neovascular disorder in a human patient comprising administering to the patient a therapeutically effective amount of a BFP-D or pharmaceutical composition comprising the BFP-D wherein at least one targeting moiety comprises an antigen binding site that binds to human VEGF and the BFP-D further comprises a conjugated cytotoxic drug, such as a drug selected from Table 9. In a further embodiment, the intraocular neovascular disorder is selected from the group consisting of diabetic and other proliferative retinopathies including retinopathy of prematurity, retrolental fibroplasia, neovascular glaucoma, and age-related macular degeneration.

Disorders Mediated by HER2-Expressing Cells

In another embodiment, the binding fusion protein is used to treat disorders mediated by HER2-expressing cells. The invention provides a method for treating a human disease mediated by HER2-expressing cells with a binding fusion protein composition that is derived from a parental antibody that binds to HER2. Such compositions have prophylactic and therapeutic applications in a broad spectrum of HER2-expressing cell-mediated disorders, including pathologies supported by the proliferation of cells expressing HER2, such as cancers characterized by over-expression of HER2, in a manner similar to the application of full length anti-Her2 antibodies in the treatment of such disease indications that is known in the art, which treatment indications include HER2-overexpressing breast, ovarian and lung cancers.

In one embodiment, the invention provides a method of treating a HER2-expressing cell mediated disorder in a human patient comprising administering to the patient a therapeutically effective amount of a BFP-D or pharmaceutical composition comprising a BFP-D wherein at least one targeting moiety in the binding fusion protein comprises an antigen binding site that binds to HER2, and the BFP-D further comprises a conjugated cytotoxic drug, such as a drug selected from Table 9. The disorder can be a HER2-expressing cell proliferative disorder, including a benign or malignant tumor characterized by the over-expression of the ErbB2 receptor, e.g. a cancer, such as, breast cancer, squamous cell cancer, small-cell lung cancer, non-small cell lung cancer, gastrointestinal cancer, pancreatic cancer, glioblastoma, cervical cancer, ovarian cancer, liver cancer, bladder cancer, hepatoma, colon cancer, colorectal cancer, endometrial carcinoma, salivary gland carcinoma, kidney cancer, liver cancer, prostate cancer, vulval cancer, thyroid cancer, hepatic carcinoma and various types of head and neck cancer. In addition, the invention contemplates the use of the foregoing conjugate in place of full-length anti-Her2 antibody in the treatment of HER2-overexpressing cancers as described in U.S. Pat. No. 5,725,856.

In one non-limiting exemplary method, the invention provides a method of inhibiting growth of tumor cells by administering to a patient a therapeutically effective amount of anti-HER2 BFP-D composition capable of inhibiting the HER2 receptor function by the targeting moiety component and/or inhibiting or killing the HER2 cell by the drug component, such as, but not limited to epaclitaxel, paclitaxel, docetaxel, doxetaxel, irinotecan, pemetrexed, chloranbucil, or gemcitabine, or a suitable cytotoxic drug selected from Table 9.

A further embodiment of the invention relates to administering a therapeutically effective amount of anti-HER2 composition capable of inhibiting growth factor receptor function. Still another object of the invention is to provide methods for the treatment and/or prevention of erbB-2 receptor over-expressing tumors comprising the administration of an anti-tumor effective amount of at least one of the disclosed anti-HER2 BFP-D capable of binding to cancer cells associated by the over-expression of erbB-2 protein. In another embodiment, the invention provides a method for the treatment and/or prevention of erbB-2 receptor over-expressing tumors comprising the administration of therapeutically-effective amounts of anti-Her2 BFP-D comprising a first and a second anti-Her2 binding moiety, which may be the same or which may bind different epitopes of the erbB-2 protein, capable of inhibiting the HER2 receptor function, and one or more drug molecules selected from Table 9. Preferably, such combinations of binding moieties and drug will exhibit better cytotoxic activity than would be expected for the sum of the cytotoxic activity of the individual antibodies and separately administered drugs at the same or lower overall concentrations of the individual components.

Disorders Mediated by EGFR-Expressing Cells

In one embodiment, the invention provides a method for treating a human disease mediated by EGFR-expressing cells with a BFP-D that is derived from a parental antibody that binds to human EGFR (a.k.a., ErbB-1 or Her1) and further comprises a drug selected from Table 9. Such BFP-D can have prophylactic and therapeutic applications in a broad spectrum of EGFR-expressing cell-mediated disorders, including pathologies supported by the proliferation of cells expressing EGFR, such as cancers characterized by over-expression of EGFR, including cancers of the breast, ovary, head and neck, brain, bladder, pancreas, and lung.

In one embodiment, the invention provides a method of treating a cell proliferation disorder in a human patient characterized by over-expression of EGFR comprising administering to the patient a therapeutically effective amount of a BFP-D wherein at least one targeting moiety in the binding fusion protein comprises an antigen binding site that binds to human EGFR and further comprises a cytotoxic drug known to be effective against EGFR-bearing cells. The disorder can be a benign or malignant tumor characterized by the over-expression of the EGFR, e.g. a cancer, such as, breast cancer, squamous cell cancer, small-cell lung cancer, non-small cell lung cancer, gastrointestinal cancer, pancreatic cancer, glioblastoma, cervical cancer, ovarian cancer, liver cancer, bladder cancer, hepatoma, colon cancer, colorectal cancer, endometrial carcinoma, salivary gland carcinoma, kidney cancer, liver cancer, prostate cancer, vulval cancer, thyroid cancer, hepatic carcinoma and various types of head and neck cancer.

Disorders Mediated by CD20-Expressing Cells

In another embodiment, the invention provides a method of treating disorders mediated by CD20-expressing cells. The invention provides a method for treating a human disease mediated by CD20-expressing cells with a BFP-D composition that is derived from a parental antibody that binds to human CD20 and further comprises a cytotoxic drug known to have activity against CD20 expressing cells, such as a drug selected from Table 9. Such compositions have prophylactic and therapeutic applications in a broad spectrum of CD20-expressing cell-mediated disorders, including pathologies supported by the proliferation of CD20-expressing cells, such as cancers of CD20-expressing cells, in a manner similar to the application of full length anti-CD20 antibodies in the treatment of such disease indications known in the art, which treatment indications include B-lymphocytic lymphomas, as described in U.S. Pat. No. 6,682,734.

Disorders Mediated by CD18-Expressing Cells

In another embodiment, the invention provides a method of treating disorders mediated by CD18-expressing cells. The invention provides a method for treating a human disease mediated by CD18-expressing cells with a BFP-D composition that is derived from a parental antibody that binds to human CD18 and further comprises a cytotoxic drug known to have activity against CD18 expressing cells, such as a drug selected from Table 9. Such compositions have prophylactic and therapeutic applications in a broad spectrum of CD18-expressing cell-mediated disorders, including pathologies supported by leukocyte adhesion, in a manner similar to the application of full length anti-CD18 antibodies in the treatment of such disease indications known in the art, which treatment indications include acute myocardial infarction and stroke. In one embodiment, the invention provides a method of treating a disorder in a human patient mediated by a CD18-expressing cell, comprising administering to the patient a therapeutically effective amount of a BFP-D wherein at least one targeting moiety in the conjugate comprises an antigen binding site that binds to human CD18, and the BFP-D further comprises a conjugated drug known to have beneficial effects in the treatment of myocardial infarction and stroke, such as a drug selected from Table 9. In another embodiment, the CD18-expressing cell-mediated disorder is an inflammatory disorder, such as an ischemic reperfusion disorder, including acute myocardial infarction and stroke. In addition, the invention contemplates the use of the foregoing binding fusion protein in place of full-length anti-CD18 antibody in the treatment of stroke as described in PCT Publication WO 97/26912.

In another embodiment, the invention provides a method of treating a LFA-1-mediated disorder in a human, comprising administering to the patient a therapeutically effective amount of a binding fusion protein wherein at least one targeting moiety in the conjugate comprises a targeting moiety that binds to human CD18, and the BFP-D further comprises a conjugated immunosuppressive drug, such as a drug selected from Table 9. In addition, the invention contemplates the use of the foregoing binding fusion protein in place of full-length anti-CD18 antibody in the treatment of an LFA-1-mediated disorder, such as psoriasis and graft rejection, in a human patient as described in U.S. Pat. No. 5,622,700.

Disorders Mediated by CD11a-Expressing Cells

In another embodiment, the invention provides a method of treating disorders mediated by CD11a-expressing cells. In one embodiment, the invention provides a method for treating a human disease mediated by a CD11a-expressing cell with a binding fusion protein composition that is derived from a parental antibody that binds to human CD11a and further comprises an immunosuppressive or cytotoxic drug known to have activity against CD11a expressing cells. Such compositions have prophylactic and therapeutic applications in a broad spectrum of CD11a-expressing cell-mediated disorders, including pathologies supported by leukocyte adhesion, in a manner similar to the application of full length anti-CD11a antibodies in the treatment of such disease indications known in the art, which treatment indications include psoriasis, asthma, graft rejection, and multiple sclerosis. In another embodiment, the invention provides a method of treating a LFA-1-mediated disorder in a human, comprising administering to the patient a therapeutically effective amount of a binding fusion protein wherein at least one targeting moiety in the conjugate comprises an antigen binding site that binds to human CD11a. In addition, the invention contemplates the use of the foregoing binding fusion protein in place of full-length anti-CD11a antibody in the treatment of an LFA-1-mediated disorder, such as psoriasis and graft rejection, in a human patient as described in U.S. Pat. No. 5,622,700. In another aspect, the invention contemplates the use of the foregoing binding fusion proteins in place of full-length anti- CD11a antibody in the treatment of LFA-1-mediated disorders in a human patient as described in U.S. Pat. No. 6,037,454.

Disorders Mediated by CD3-Expressing Cells

In one embodiment, the invention provides a method for treating a human disease or disorder mediated by CD3-expressing cells with a binding fusion protein that is derived from a parental antibody that binds to human CD3 and further comprises a cytotoxic or immunosuppressive drug known to have activity against CD3 expressing cells, such as a drug selected from Table 9. Such binding fusion proteins can have prophylactic and therapeutic applications in a broad spectrum of CD3-expressing cell-mediated disorders, including conditions associated with the proliferation or activation of cells expressing CD3, such as immune disorders mediated by T-lymphocytes and graft rejection in transplant recipients. The use of anti-CD3 antibodies to treat diseases and disorders has been described, for example, in U.S. Pat. No. 4,515,893. In another aspect, the invention contemplates the use of the foregoing binding fusion protein in place of full length anti-human CD3 antibody in the treatment of acute allograft rejection in kidney transplant recipients as described for ORTHOCLONE OKT3 muromonab-CD3 in *Physician's Desk Reference*, $52^{nd}$ Edition (1998), pp. 1971-1974.

Disorders Mediated by TAC-Expressing Cells

In one embodiment, the invention provides a method for treating a human disease mediated by interleukin-2 receptor α-chain (TAC)-expressing cells with a binding fusion protein that is derived from a parental antibody that binds to human TAC and further comprises a cytotoxic drug known to have activity against TAC expressing cells. Such binding fusion proteins can have prophylactic and therapeutic applications in a broad spectrum of TAC-expressing cell-mediated disorders, including conditions created by the proliferation or activation of cells expressing TAC and immune disorders mediated by T-lymphocytes or B-lymphocytes, including graft rejection in transplant recipients.

In one embodiment, the invention provides a method of treating a disorder in a human patient mediated by a TAC-expressing cell, comprising administering to the patient a therapeutically effective amount of a binding fusion protein wherein at least one targeting moiety in the binding fusion protein comprises an antigen binding site that binds to human TAC, and the BFP-D further comprises a conjugated immunosuppressive or cytotoxic drug, such as a drug selected from Table 9. In another embodiment, the TAC-expressing cell-mediated disorder is characterized by the activation or proliferation of T-lymphocytes or B-lymphocytes, including immune disorders such as graft rejection in transplant recipients, graft-versus-host disease (GHVD), graft rejection in transplant recipients, such as acute graft rejection in renal transplant recipients, and autoimmune diseases such as Type I diabetes, multiple sclerosis, rheumatoid arthritis, systemic lupus erythematosus, and myasthenia gravis. The use of antibodies to treat disorders mediated by interleukin-2 receptor α-chain with antibodies has been described in U.S. Pat. No. 5,693,761.

TNF-α-Mediated Disorders

In one embodiment, the invention provides a method for treating a TNF-α-mediated disease with a binding fusion protein that is derived from a parental antibody that binds to human TNF-α and further comprises a cytotoxic or anti-inflammatory drug, such as a drug selected from Table 9. Such binding fusion proteins can have prophylactic and therapeutic applications in a broad spectrum of TNF-α-mediated disorders, including inflammatory disorders and immune disorders, in a manner similar to the application of full-length anti-human TNF-α antibodies in the treatment of such disease indications such as Crohn's disease, inflammatory bowel disease, and rheumatoid arthritis.

In one embodiment, the invention provides a method of treating an inflammatory disorder in a human patient comprising administering to the patient a therapeutically effective amount of a binding fusion protein wherein at least one targeting moiety in the binding fusion protein comprises an antigen binding site that binds to human TNF-α. In another embodiment, the inflammatory disorder is Crohn's disease. In yet another embodiment, the inflammatory disorder is inflammatory bowel disease. In still another embodiment, the inflammatory disorder is rheumatoid arthritis. The use of antibodies that bind to human TNF-α in the treatment of inflammatory conditions have been described, for example, in U.S. Pat. Nos. 5,672,347, 5,656,272, and 5,698,195.

Tissue Factor-Mediated Disorders

In one embodiment, the invention provides a method for treating a tissue factor-mediated disease with a binding fusion protein derived from a parental antibody that binds to human tissue factor, and the BFP-D further comprises a conjugated anticoagulant or antithrombosis drug, such as a drug selected from Table 9. Such binding fusion proteins can have prophylactic and therapeutic applications in a broad spectrum of tissue factor-mediated disorders, including pathologies supported by blood coagulation and in the treatment of such disease indications as deep vein thrombosis, arterial thrombosis, atherosclerosis, vascular stenosis, myocardial ischemic diseases including acute myocardial infarction, reocclusion following angioplasty or atherectomy or thrombolytic treatment for acute myocardial infarction, angina, cerebral ischemic diseases including stroke, venous thrombophlebitis, and pulmonary embolism. In one embodiment, the invention provides a method of treating a tissue factor-mediated disease or disorder (such as the foregoing) in a human patient comprising administering to the patient a therapeutically effective amount of a binding fusion protein wherein at least one targeting moiety in the binding fusion protein comprises an antigen binding site that binds to human tissue factor.

III). The DNA Sequences of the Invention

Figure 7:
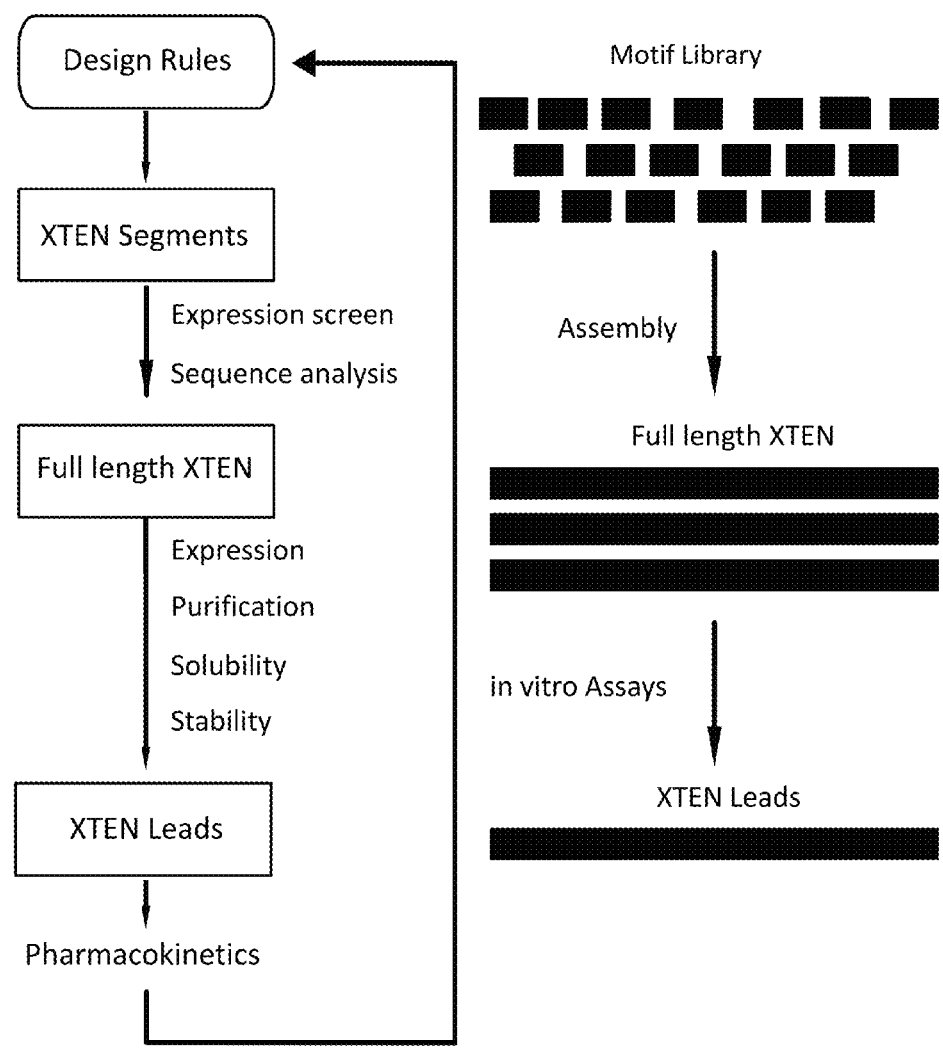
FIG. 7 is a schematic flowchart of representative steps in the assembly, production and the evaluation of a XTEN.
Figure 8:
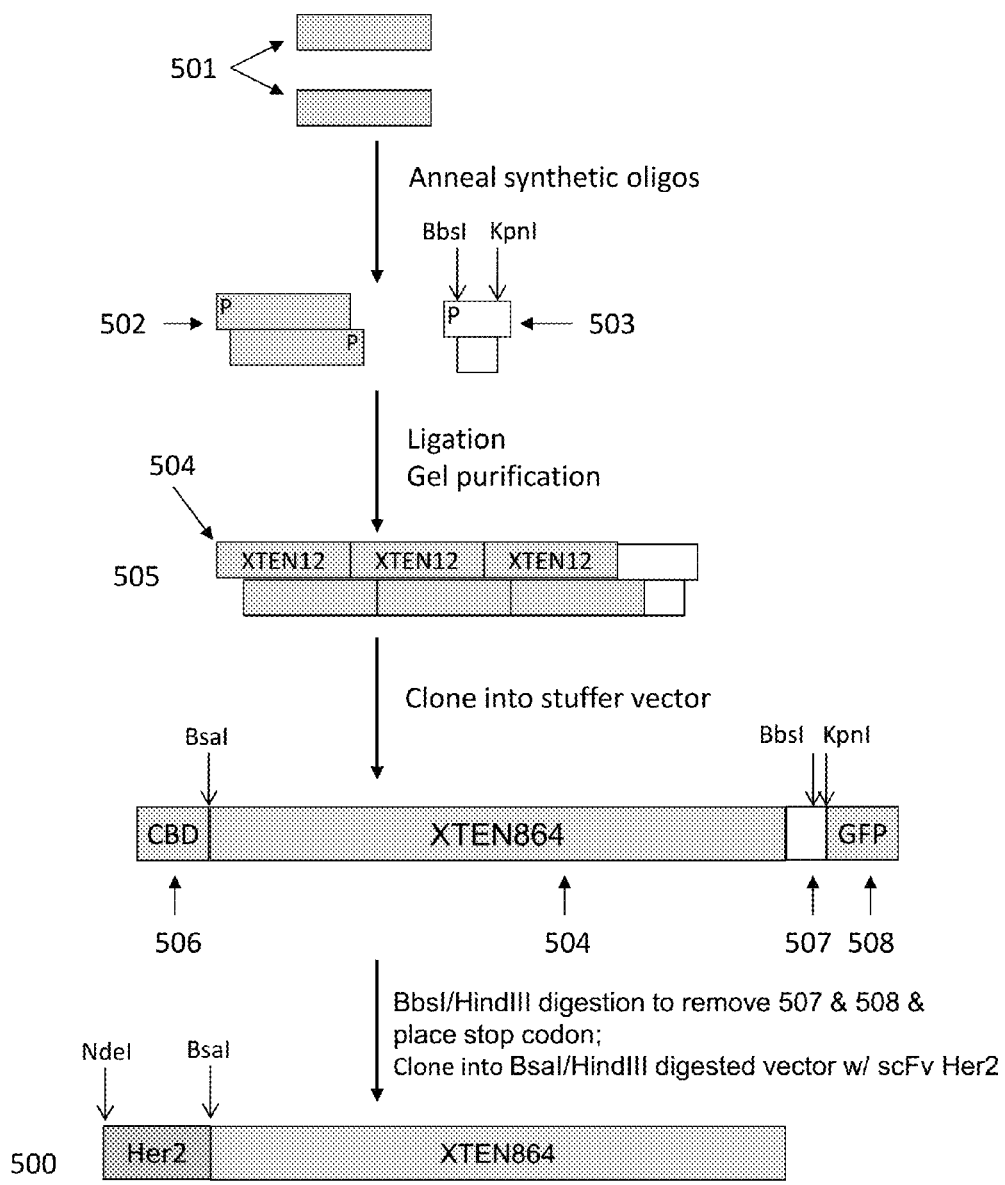
FIG. 8 is a schematic flowchart of representative steps in the assembly of a targeting moiety-XTEN polynucleotide construct encoding, in this case, an anti-Her2 binding fusion protein. Individual oligonucleotides 501 are annealed into sequence motifs 502 such as a 12 amino acid motif ("12-mer"), which is ligated to additional sequence motifs from a library to create a pool that encompasses the desired length of the XTEN 504, as well as ligated to a smaller concentration of an oligo containing BbsI, and KpnI restriction sites 503. The resulting pool of ligation products is gel-purified and the band with the desired length of XTEN is cut, resulting in an isolated XTEN gene with a stopper sequence 505. The XTEN gene is cloned into a stuffer vector. In this case, the vector encodes an optional CBD sequence 506 and a GFP gene 508. Digestion is than performed with BbsI/HindIII to remove 507 and 508 and place the stop codon. The resulting product is then cloned into a BsaI/HindIII digested vector containing a gene encoding the svFv anti-Her2, resulting in the gene 500 encoding an binding fusion protein.

The present invention provides isolated polynucleic acids encoding XTEN and binding fusion protein chimeric polypeptides and sequences complementary to polynucleic acid molecules encoding XTEN and binding fusion protein chimeric polypeptides, including homologous variants. In another aspect, the invention encompasses methods to produce polynucleic acids encoding XTEN and binding fusion protein chimeric polypeptides and sequences complementary to polynucleic acid molecules encoding binding fusion protein chimeric polypeptides, including homologous variants. In general, and as illustrated in FIGS. 7-9, the methods of producing a polynucleotide sequence coding for an XTEN or a binding fusion protein and expressing the resulting gene product include assembling nucleotides encoding targeting moieties and XTEN (and any linker sequences, if any), linking the components in frame, incorporating the encoding gene into an appropriate expression vector, transforming an appropriate host cell with the expression vector, and causing the fusion protein to be expressed in the transformed host cell, thereby producing the biologically-active binding fusion protein. Standard recombinant techniques in molecular biology can be used to make the polynucleotides and expression vectors of the present invention.

In accordance with the invention, nucleic acid sequences that encode XTEN and binding fusion proteins may be used to generate recombinant DNA molecules that direct the expression of XTEN and binding fusion proteins in appropriate host cells. Several cloning strategies are envisioned to be suitable for performing the present invention, many of which can be used to generate a construct that comprises a gene coding for a binding fusion protein composition of the present invention, or its complement. In one embodiment, the cloning strategy would be used to create a gene that encodes an XTEN polypeptide. In another embodiment, the cloning strategy would be used to create a gene that encodes a monomeric binding fusion protein that comprises at least a first targeting moiety and at least a first XTEN polypeptide, or its complement. In another embodiment, the cloning strategy would be used to create a gene that encodes a monomeric binding fusion protein that comprises a first and a second targeting moiety and at least a first XTEN, or its complement. In another embodiment, the cloning strategy would be used to create a gene that encodes a monomeric binding fusion protein that comprises at least a first and a second targeting moiety, a linker, and at least a first XTEN, or its complement. In the foregoing embodiments, the gene would be used in a suitable expression vector to transform a host cell for expression of the fusion protein.

In designing a desired XTEN sequences, it was discovered that the non-repetitive nature of the XTEN of the inventive compositions can be achieved despite use of a "building block" molecular approach in the creation of the XTEN-encoding sequences. This was achieved by the use of a library of polynucleotides encoding sequence motifs that are then multimerized to create the genes encoding the XTEN sequences (see FIGS. 7 and 8). Thus, while the expressed XTEN may consist of multiple units of as few as four different sequence motifs, because the motifs themselves consist of non-repetitive amino acid sequences, the overall XTEN sequence is rendered non-repetitive. Accordingly, in one embodiment, the XTEN-encoding polynucleotides comprise multiple polynucleotides that encode non-repetitive sequences, or motifs, operably linked in frame and in which the resulting expressed XTEN amino acid sequences are non-repetitive.

In one approach, a construct is first prepared containing the DNA sequence corresponding to binding fusion protein. DNA encoding the targeting moiety of the compositions may be obtained from a cDNA library prepared using standard methods from tissue or isolated cells believed to possess targeting moiety mRNA and to express it at a detectable level. If necessary, the coding sequence can be obtained using conventional primer extension procedures as described in Sambrook, et al., supra, to detect precursors and processing intermediates of mRNA that may not have been reverse-transcribed into cDNA. Accordingly, DNA can be conveniently obtained from a cDNA library prepared from such sources. The target moiety encoding gene(s) may also be obtained from a genomic library or created by standard synthetic procedures known in the art (e.g., automated nucleic acid synthesis) using DNA sequences obtained from publicly available databases, patents, or literature references. Such procedures are well known in the art and well described in the scientific and patent literature. For example, sequences can be obtained from Chemical Abstracts Services (CAS) Registry Numbers (published by the American Chemical Society) and/or GenBank Accession Numbers (e.g., Locus ID, NM_XXXXX, NP_XXXXX, and XP_XXXXX) Model Protein identifiers available through the National Center for Biotechnology Information (NCBI) webpage, available on the world wide web at ncbi.nlm.nih.gov that correspond to entries in the CAS Registry or GenBank database that contain an amino acid sequence of the targeting moiety (e.g., an antibody) or of a fragment or variant of the targeting moiety. For such sequence identifiers provided herein, the summary pages associated with each of these CAS and GenBank and GenSeq Accession Numbers as well as the cited journal publications (e.g., PubMed ID number (PMID)) are each incorporated by reference in their entireties, particularly with respect to the amino acid sequences described therein. In one embodiment, the binding fusion protein encoding gene encodes a protein from any one of Tables 25, 38 or 39, or a fragment or variant thereof.

A gene or polynucleotide encoding the targeting moiety portion of the subject binding fusion protein, in the case of an expressed fusion protein that will comprise a single targeting moiety, can be then be cloned into a construct, which can be a plasmid or other vector under control of appropriate transcription and translation sequences for high level protein expression in a biological system. In a later step, a second gene or polynucleotide coding for the XTEN is genetically fused to the nucleotides encoding the N- and/or C-terminus of the targeting moiety gene by cloning it into the construct adjacent and in frame with the gene(s) coding for the targeting moiety. This second step can occur through a ligation or multimerization step. In the foregoing embodiments hereinabove described in this paragraph, it is to be understood that the gene constructs that are created can alternatively be the complement of the respective genes that encode the respective fusion proteins. In addition, for binding fusion proteins comprising two or more targeting moieties and linkers, the gene or polynucleotides coding for these components would be cloned into the construct adjacent to and in frame relative to the other components described above, depending on the desired final configuration of the fusion protein. In a particular aspect of the foregoing, it was discovered that use of alternative encoding sequences for multivalent (e.g., two or more) targeting moieties reduces the risk of homologous recombination during expression. Accordingly, for binding fusion proteins that have repeat binding domains or multivalent targeting moieties with the same or very similar sequences, the invention provides encoding polynucleotides for the respective domains that have different DNA sequences. In a non-limiting example of the foregoing, the invention provides a binding fusion protein with dimeric Ig-like targeting moieties wherein the codons for certain amino acids for the encoding gene for each targeting moiety are varied, wherein the incidence of recombination during expression in a transformed host is reduced compared to a comparable host transformed with targeting genes which are identical.

The gene encoding for the XTEN can be made in one or more steps, either fully synthetically or by synthesis combined with enzymatic processes, such as restriction enzyme-mediated cloning, PCR and overlap extension. XTEN polypeptides can be constructed such that the XTEN-encoding gene has low repetitiveness. Genes encoding XTEN with non-repetitive sequences can be assembled from oligonucleotides using standard techniques of gene synthesis. The gene design can be performed using algorithms that optimize codon usage and amino acid composition. In one method of the invention, a library of relatively short XTEN-encoding polynucleotide constructs is created and then assembled, as illustrated in FIGS. 7 and 8. This can be a pure codon library such that each library member has the same amino acid sequence but many different coding sequences are possible. Such libraries can be assembled from partially randomized oligonucleotides and used to generate large libraries of XTEN segments comprising the sequence motifs. The randomization scheme can be optimized to control amino acid choices for each position as well as codon usage.

Polynucleotide Libraries

In another aspect, the invention provides libraries of polynucleotides that encode XTEN sequences that can be used to assemble genes that encode XTEN of a desired length and sequence, which are useful for the creation of genes encoding binding fusion proteins.

In certain embodiments, the XTEN-encoding library constructs comprise polynucleotides that encode polypeptide segments of a fixed length. As an initial step, a library of oligonucleotides that encode motifs of 9-14 amino acid residues can be assembled. In a preferred embodiment, libraries of oligonucleotides that encode motifs of 12 amino acids are assembled.

The XTEN-encoding sequence segments can be dimerized or multimerized into longer encoding sequences. Dimerization or multimerization can be performed by ligation, overlap extension, PCR assembly or similar cloning techniques known in the art. This process of can be repeated multiple times until the resulting XTEN-encoding sequences have reached the organization of sequence and desired length, providing the XTEN-encoding genes. As will be appreciated, a library of polynucleotides that encodes 12 amino acids can be dimerized into a library of polynucleotides that encode 36 amino acids. In turn, the library of polynucleotides that encode 36 amino acids can be serially dimerized into a library containing successively longer lengths of polynucleotides that encode XTEN sequences. In some embodiments, libraries can be assembled of polynucleotides that encode amino acids that are limited to specific sequence XTEN families; e.g., AD, AE, AF, AG, AM, AQ, BC, or BD sequences of Table 3. In other embodiments, libraries can comprises sequences that encode two or more of the motif family sequences from Table 3. The names and sequences of representative, non-limiting polynucleotide sequences of libraries that encode 36mers are presented in Tables 11-14, and the methods used to create them are described more fully in the Examples. The libraries can be used, in turn, for serial dimerization or ligation to achieve polynucleotide sequence libraries that encode XTEN sequences, for example, of 72, 144, 288, 576, 864, 912, 923, 1296 amino acids, or up to a total length of about 3000 amino acids, as well as intermediate lengths. In one embodiment, the polynucleotide library sequences may also include additional bases used as "sequencing islands," described more fully below.

FIG. 8 is a schematic flowchart of representative, non-limiting steps in the assembly of a XTEN polynucleotide construct and a binding fusion protein polynucleotide construct utilized in the XTEN, binding fusion protein and BFP-D embodiments of the invention. Individual oligonucleotides 501 can be annealed into sequence motifs 502 such as a 12 amino acid motif ("12-mer"), which is subsequently ligated with an oligo containing BbsI, and KpnI restriction sites 503. Additional sequence motifs from a library are annealed to the 12-mer until the desired length of the XTEN gene 504 is achieved. The XTEN gene is cloned into a stuffer vector. The vector can optionally encode a Flag sequence 506 followed by a stuffer sequence that is flanked by BsaI, BbsI, and KpnI sites 507 and, in this case, a single targeting moiety gene (encoding anti-Her2 in this example) 508, resulting in the gene encoding a binding fusion protein comprising a single targeting moiety 500. A non-exhaustive list of the XTEN names and sequences for polynucleotides encoding XTEN and precursor sequences is provided in Table 10.

TABLE 10

DNA sequences of XTEN and precursor sequences

| XTEN Name | DNA Sequence | SEQ ID NO: |
|---|---|---|
| AE144 | GGTAGCGAACCGGCAACTTCCGGCTCTGAAACCCCAGGTACTTCTGAAAGCGCTAC TCCTGAGTCTGGCCCAGGTAGCGAACCTGCTACCTCTGGCTCTGAAACCCCAGGTA GCCCGGCAGGCTCTCCGACTTCCACCGAGGAAGGTACCTCTACTGAACCTTCTGAG GGTAGCGCTCCAGGTAGCGAACCGGCAACCTCTGGCTCTGAAACCCCAGGTAGCG AACCTGCTACCTCCGGCTCTGAAACTCCAGGTAGCGAACCGGCTACTTCCGGTTCT GAAACTCCAGGTACCTCTACCGAACCTTCCGAAGGCAGCGCACCAGGTACTTCTGA AAGCGCAACCCCTGAATCCGGTCCAGGTAGCGAACCGGCTACTTCTGGCTCTGAGA CTCCAGGTACTTCTACCGAACCGTCCGAAGGTAGCGCACCA | 202 |
| AF144 | GGTACTTCTACTCCGGAAAGCGGTTCCGCATCTCCAGGTACTTCTCCTAGCGGTGA ATCTTCTACTGCTCCAGGTACCTCTCCTAGCGGCGAATCTTCTACTGCTCCAGGTTC TACCAGCTCTACCGCTGAATCTCCTGGCCCAGGTTCTACCAGCGAATCCCCGTCTGG CACCGCACCAGGTTCTACTAGCTCTACCGCAGAATCTCCGGGTCCAGGTACTTCCC CTAGCGGTGAATCTTCTACTGCTCCAGGTACCTCTACTCCGGAAAGCGGCTCCGCA TCTCCAGGTTCTACTAGCTCTACTGCTGAATCTCCTGGTCCAGGTACCTCCCCTAGC GGCGAATCTTCTACTGCTCCAGGTACCTCTCCTAGCGGCGAATCTTCTACCGCTCCA GGTACCTCCCCTAGCGGTGAATCTTCTACCGCACCA | 203 |
| AE288 | GGTACCTCTGAAAGCGCAACTCCTGAGTCTGGCCCAGGTAGCGAACCTGCTACCTC CGGCTCTGAGACTCCAGGTACCTCTGAAAGCGCAACCCCGGAATCTGGTCCAGGTA GCGAACCTGCAACCTCTGGCTCTGAAACCCCAGGTACCTCTGAAAGCGCTACTCCT GAATCTGGCCCAGGTACTTCTACTGAACCGTCCGAGGGCAGCGCACCAGGTAGCCC TGCTGGCTCTCCAACCTCCACCGAAGAAGGTACCTCTGAAAGCGCAACCCCTGAAT CCGGCCCAGGTAGCGAACCGGCAACCTCCGGTTCTGAAACCCCAGGTACTTCTGAA AGCGCTACTCCTGAGTCCGGCCCAGGTAGCCCGGCTGGCTCTCCGACTTCCACCGA GGAAGGTAGCCCGGCTGGCTCTCCAACTTCTACTGAAGAAGGTACTTCTACCGAAC CTTCCGAGGGCAGCGCACCAGGTACTTCTGAAAGCGCTACCCCTGAGTCCGGCCCA GGTACTTCTGAAAGCGCTACTCCTGAATCCGGTCCAGGTACTTCTGAAAGCGCTAC CCCGGAATCTGGCCCAGGTAGCGAACCGGCTACTTCTGGTTCTGAAACCCCAGGTA GCGAACCGGCTACCTCCGGTTCTGAAACTCCAGGTAGCCCAGCAGGCTCTCCGACT TCCACTGAGGAAGGTACTTCTACTGAACCTTCCGAAGGCAGCGCACCAGGTACCTC TACTGAACCTTCTGAGGGCAGCGCTCCAGGTAGCGAACCTGCAACCTCTGGCTCTG | 204 |

TABLE 10-continued

DNA sequences of XTEN and precursor sequences

| XTEN Name | DNA Sequence | SEQ ID NO: |
|---|---|---|
| | AAACCCCAGGTACCTCTGAAAGCGCTACTCCTGAATCTGGCCCAGGTACTTCTACT GAACCGTCCGAGGGCAGCGCACCA | |
| AE576 | GGTAGCCCGGCTGGCTCTCCTACCTCTACTGAGGAAGGTACTTCTGAAAGCGCTAC TCCTGAGTCTGGTCCAGGTACCTCTACTGAACCGTCCGAAGGTAGCGCTCCAGGTA GCCCAGCAGGCTCTCCGACTTCCACTGAGGAAGGTACTTCTACTGAACCTTCCGAA GGCAGCGCACCAGGTACCTCTACTGAACCTTCTGAGGGCAGCGCTCCAGGTACTTC TGAAAGCGCTACCCCGGAATCTGGCCCAGGTAGCGAACCGGCTACTTCTGGTTCTG AAACCCCAGGTAGCGAACCGGCTACCTCCGGTTCTGAAACTCCAGGTAGCCCGGCA GGCTCTCCGACCTCTACTGAGGAAGGTACTTCTGAAAGCGCAACCCCGGAGTCCGG CCCAGGTACCTCTACCGAACCGTCTGAGGGCAGCGCACCAGGTACTTCTACCGAAC CGTCCGAGGGTAGCGCACCAGGTAGCCCAGCAGGTTCTCCTACCTCCACCGAGGAA GGTACTTCTACCGAACCGTCCGAGGGTAGCGCACCAGGTACCTCTACTGAACCTTC TGAGGGCAGCGCTCCAGGTACTTCTGAAAGCGCTACCCCGGAGTCCGGTCCAGGTA CTTCTACTGAACCGTCCGAAGGTAGCGCACCAGGTACTTCTGAAAGCGCAACCCCT GAATCCGGTCCAGGTAGCGAACCGGCTACTTCTGGCTCTGAGACTCCAGGTACTTC TACCGAACCGTCCGAAGGTAGCGCACCAGGTACTTCTACTGAACCGTCTGAAGGTA GCGCACCAGGTACTTCTGAAAGCGCAACCCCGGAATCCGGCCCAGGTACCTCTGAA AGCGCAACCCCGGAGTCCGGCCCAGGTAGCCCTGCTGGCTCTCCAACCTCCACCGA AGAAGGTACCTCTGAAAGCGCAACCCCTGAATCCGGCCCAGGTAGCGAACCGGCA ACCTCCGGTTCTGAAACCCCAGGTACCTCTGAAAGCGCTACTCCGGAGTCTGGCCC AGGTACCTCTACTGAACCGTCTGAGGGTAGCGCTCCAGGTACTTCTACTGAACCGT CCGAAGGTAGCGCACCAGGTACTTCTACCGAACCGTCGAAGGCAGCGCTCCAGGT ACCTCTACTGAACCTTCCGAGGGCAGCGCTCCAGGTACCTCTACCGAACCTTCTGA AGGTAGCGCACCAGGTACTTCTACCGAACCGTCCGAGGGTAGCGCACCAGGTAGC CCAGCAGGTTCTCCTACCTCCACCGAGGAAGGTACTTCTACCGAACCGTCCGAGGG TAGCGCACCAGGTACCTCTGAAAGCGCAACTCCTGAGTCTGGCCCAGGTAGCGAAC CTGCTACCTCCGGCTCTGAGACTCCAGGTACCTCTGAAAGCGCAACCCCGGAATCT GGTCCAGGTAGCGAACCTGCAACCTCTGGCTCTGAAACCCCAGGTACCTCTGAAAG CGCTACTCCTGAATCTGGCCCAGGTACTTCTACTGAACCGTCGAGGGCAGCGCAC CAGGTACTTCTGAAAGCGCTACTCCTGAGTCCGGCCCAGGTAGCCCGGCTGGCTCT CCGACTTCCACCGAGGAAGGTAGCCCGGCTGGCTCTCCAACTTCTACTGAAGAAGG TAGCCCGGCAGGCTCTCCGACCTCTACTGAGGAAGGTACTTCTGAAAGCGCAACCC CGGAGTCCGGCCCAGGTACCTCTACCGAACCGTCTGAGGGCAGCGCACCA | 205 |
| AF576 | GGTTCTACTAGCTCTACCGCTGAATCTCCTGGCCCAGGTTCCACTAGCTCTACCGCA GAATCTCCGGGCCCAGGTTCTACTAGCGAATCCCCTTCTGGTACCGCTCCAGGTTCT ACTAGCTCTACCGCTGAATCTCCGGGTCCAGGTTCTACCAGCTCTACTGCAGAATCT CCTGGCCCAGGTACTTCTACTCCGGAAAGCGGTTCCGCTTCTCCAGGTTCTACCAGC GAATCTCCTTCTGGCACCGCTCCAGGTACCTCTCCTAGCGGCGAATCTTCTACCGCT CCAGGTTCTACTAGCGAATCTCCTTCTGGCACTGCACCAGGTTCTACCAGCGAATCT CCTTCTGGCACCGCTCCAGGTACCTCTCCTAGCGGCGAATCTTCTACCGCTCCAGGT TCTACTAGCGAATCTCCTTCTGGCACTGCACCAGGTTCTACCAGCGAATCTCCTTCT GGCACCGCTCCAGGTACCTCTCCTAGCGGCGAATCTTCTACCGCTCCAGGTTCTACT AGCGAATCTCCTTCTGGCACTGCACCAGGTTCTACTAGCGAATCTCCTTCTGGCACT GCACCAGGTTCTACCAGCGAATCTCCGTCTGGCACTGCACCAGGTACCTCTACCCC TGAAAGCGGTTCCGCTTCTCCAGGTTCTACTAGCGAATCTCCTTCTGGTACCGCTCC AGGTACTTCTACCCCTGAAAGCGGCTCCGCTTCTCCAGGTTCCACTAGCTCTACCGC TGAATCTCCGGGTCCAGGTTCTACTAGCTCTACTGCAGAATCTCCTGGCCCAGGTAC CTCTACTCCGGAAAGCGGCTCTGCATCTCCAGGTACTTCTACCCCTGAAAGCGGTTC TGCATCTCCAGGTTCTACTAGCGAATCCCCGTCTGGTACCGCACCAGGTACTTCTAC CCCGGAAAGCGGCTCTGCTTCTCCAGGTACTTCTACCCCGGAAAGCGGCTCCGCAT CTCCAGGTTCTACTAGCGAATCTCCTTCTGGTACCGCTCCAGGTTCTACCAGCGAAT CCCCGTCTGGTACTGCTCCAGGTTCTACCAGCGAATCTCCTTCTGGTACTGCACCAG GTTCTACTAGCTCTACTGCAGAATCTCCTGGCCCAGGTACCTCTACTCCGGAAAGC GGCTCTGCATCTCCAGGTACTTCTACCCCTGAAAGCGGTTCTGCATCTCCAGGTTCT ACTAGCGAATCTCCTTCTGGCACTGCACCAGGTTCTACCAGCGAATCTCCGTCTGGC ACTGCACCAGGTACCTCTACCCCTGAAAGCGGTTCCGCTTCTCCAGGTTCTACTAGC GAATCTCCTTCTGGCACTGCACCAGGTTCTACCAGCGAATCTCCGTCTGGCACTGCA CCAGGTACCTCTACCCCTGAAAGCGGTTCCGCTTCTCCAGGTACTTCTCCGAGCGGT GAATCTTCTACCGCACCAGGTTCTACTAGCTCTACCGCTGAATCTCCGGGCCCAGGT ACTTCTCCGAGCGGTGAATCTTCTACTGCTCCAGGTTCCACTAGCTCTACTGCTGAA TCTCCTGGCCCAGGTACTTCTACTCCGGAAAGCGGTTCCGCTTCTCCAGGTTCTACT AGCGAATCTCCGTCTGGCACCGCACCAGGTTCTACTAGCTCTACTGCAGAATCTCCT GGCCCAGGTACCTCTACTCCGGAAAGCGGCTCTGCATCTCCAGGTACTTCTACCCCT GAAAGCGGTTCTGCATCTCCA | 206 |
| AM875 | GGTACTTCTACTGAACCGTCTGAAGGCAGCGCACCAGGTAGCGAACCGGCTACTTC CGGTTCTGAAACCCCAGGTAGCCCAGCAGGTTCTCCAACTTCTACTGAAGAAGGTT CTACCAGCTCTACCGCAGAATCTCCTGGTCCAGGTACCTCTACTCCGGAAAGCGGC TCTGCATCTCCAGGTTCTACTAGCGAATCTCCTTCTGGCACTGCACCAGGTTCTACT AGCGAATCCCCGTCTGGTACTGCTCCAGGTACTTCTACTCCTGAAAGCGGTTCCGCT TCTCCAGGTACCTCTACTCCGGAAAGCGGTTCTGCATCTCCAGGTAGCGAACCGGC AACCTCCGGCTCTGAAACCCCAGGTACCTCTGAAAGCGCTACTCCTGAATCCGGCC | 207 |

TABLE 10-continued

DNA sequences of XTEN and precursor sequences

| XTEN Name | DNA Sequence | SEQ ID NO: |
|---|---|---|
| | CAGGTAGCCCGGCAGGTTCTCCGACTTCCACTGAGGAAGGTACCTCTACTGAACCT<br>TCTGAGGGCAGCGCTCCAGGTACTTCTGAAAGCGCTACCCCGGAGTCCGGTCCAGG<br>TACTTCTACTGAACCGTCCGAAGGTAGCGCACCAGGTACTTCTACCGAACCGTCCG<br>AGGGTAGCGCACCAGGTAGCCCAGCAGGTTCTCCTACCTCCACCGAGGAAGGTACT<br>TCTACCGAACCGTCCGAGGGTAGCGCACCAGGTACTTCTACCGAACCTTCCGAGGG<br>CAGCGCACCAGGTACTTCTGAAAGCGCTACCCCTGAGTCCGGCCCAGGTACTTCTG<br>AAAGCGCTACTCCTGAATCCGGTCCAGGTACCTCTACTGAACCTTCCGAAGGCAGC<br>GCTCCAGGTACCTCTACCGAACCGTCCGAGGGCAGCGCACCAGGTACTTCTGAAAG<br>CGCAACCCCTGAATCCGGTCCAGGTACTTCTACTGAACCTTCCGAAGGTAGCGCTC<br>CAGGTAGCGAACCTGCTACTTCTGGTTCTGAAACCCCAGGTAGCCCGGCTGGCTCT<br>CCGACCTCCACCGAGGAAGGTAGCTCTACCCCGTCTGGTGCTACTGGTTCTCCAGG<br>TACTCCGGGCAGCGGTACTGCTTCTTCCTCTCAGGTAGCTCTACCCCTTCTGGTGC<br>TACTGGCTCTCCAGGTACCTCTACCGAACCGTCCGAGGGTAGCGCACCAGGTACCT<br>CTACTGAACCGTCTGAGGGTAGCGCTCCAGGTAGCGAACCGGCAACCTCCGGTTCT<br>GAAACTCCAGGTAGCCCTGCTGGCTCTCCGACTTCTACTGAGGAAGGTAGCCCGGC<br>TGGTTCTCCGACTTCTACTGAGGAAGGTACTTCTACCGAACCTTCCGAAGGTAGCG<br>CTCCAGGTGCAAGCGCAAGCGGCGCGCCAAGCACGGGAGGTACTTCTGAAAGCGC<br>TACTCCTGAGTCCGGCCCAGGTAGCCCGGCTGGCTCTCCGACTTCCACCGAGGAAG<br>GTAGCCCGGCTGGCTCTCCAACTTCTACTGAAGAAGGTTCTACCAGCTCTACCGCT<br>GAATCTCCTGGCCCAGGTTCTACTAGCGAATCTCCGTCTGGCACCGCACCAGGTAC<br>TTCCCCTAGCGGTGAATCTTCTACTGCACCAGGTACCCCTGGCAGCGGTACCGCTTC<br>TTCCTCTCCAGGTAGCTCTACCCCGTCTGGTGCTACTGGCTCTCCAGGTTCTAGCCC<br>GTCTGCATCTACCGGTACCGGCCCAGGTAGCGAACCGGCAACCTCCGGCTCTGAAA<br>CTCCAGGTACTTCTGAAAGCGCTACTCCGAATCCGGCCCAGGTAGCGAACCGGCT<br>ACTTCCGGCTCTGAAACCCCAGGTTCCACCAGCTCTACTGCAGAATCTCCGGGCCC<br>AGGTTCTACTAGCTCTACTGCAGAATCTCCGGGTCCAGGTACTTCTCCTAGCGGCG<br>AATCTTCTACCGCTCCAGGTAGCGAACCGGCAACCTCTGGCTCTGAAACTCCAGGT<br>AGCGAACCTGCAACCTCCGGCTCTGAAACCCCAGGTACTTCTACTGAACCTTCTGA<br>GGGCAGCGCACCAGGTTCTACCAGCTCTACCGCAGAATCTCCTGGTCAGGTACCT<br>CTACTCCGGAAAGCGGCTCTGCATCTCCAGGTTCTACTAGCGAATCTCCTTCTGGCA<br>CTGCACCAGGTACTTCTACCGAACCGTCCGAAGGCAGCGCTCCAGGTACCTCTACT<br>GAACCTTCCGAGGGCAGCGCTCCAGGTACCTCTACCGAACCTTCTGAAGGTAGCGC<br>ACCAGGTAGCTCTACTCGTCTGGTGCAACCGGCTCCCCAGGTTCTAGCCCGTCTGC<br>TTCCACTGGTACTGGCCCAGGTGCTTCCCCGGGCACCAGCTCTACTGGTTCTCCAGG<br>TAGCGAACCTGCTACCTCCGGTTCTGAAACCCCAGGTACCTCTGAAAGCGCAACTC<br>CGGAGTCTGGTCCAGGTAGCCCTGCAGGTTCTCCTACCTCCACTGAGGAAGGTAGC<br>TCTACTCCGTCTGGTGCAACCGGCTCCCCAGGTTCTAGCCCGTCTGCTTCCACTGGT<br>ACTGGCCCAGGTGCTTCCCCGGGCACCAGCTCTACTGGTTCTCCAGGTACCTCTGA<br>AAGCGCTACTCCGGAGTCTGGCCCAGGTACCTCTACTGAACCGTCTGAGGGTAGCG<br>CTCCAGGTACTTCTACTGAACCGTCCGAAGGTAGCGCACCA | |
| AE864 | GGTAGCCCGGCTGGCTCTCCTACCTCTACTGAGGAAGGTACTTCTGAAAGCGCTAC<br>TCCTGAGTCTGGTCCAGGTACCTCTACTGAACCGTCCGAAGGTAGCGCTCCAGGTA<br>GCCCAGCAGGTCTCTCCGACTTCCACTGAGGAAGGTACTTCTACTGAACCTTCCGAA<br>GGCAGCGCACCAGGTACCTCTACTGAACCTTCTGAGGGCAGCGCTCCAGGTACTTC<br>TGAAAGCGCTACCCCGGAATCTGGCCCAGGTAGCGAACCGGCTACTTCTGGTTCTG<br>AAACCCCAGGTAGCGAACCGGCTACCTCCGGTTCTGAAACTCCAGGTAGCCCGGCA<br>GGCTCTCCGACCTCTACTGAGGAAGGTACTTCTGAAAGCGCAACCCCGGAGTCCGG<br>CCCAGGTACCTCTACCGAACCGTCTGAGGGCAGCGCACCAGGTACTTCTACCGAAC<br>CGTCCGAGGGTAGCGCACCAGGTAGCCCAGCAGGTTCTCCTACCTCCACCGAGGAA<br>GGTACTTCTACCGAACCGTCCGAGGGTAGCGCACCAGGTACCTCTACTGAACCTTC<br>TGAGGGCAGCGCTCCAGGTACTTCTGAAAGCGCTACCCCGGAGTCCGGTCCAGGTA<br>CTTCTACTGAACCGTCCGAAGGTAGCGCACCAGGTACTTCTGAAAGCGCAACCCCT<br>GAATCCGGTCCAGGTAGCGAACCGGCTACTTCTGGCTCTGAGACTCCAGGTACTTC<br>TACCGAACCGTCCGAAGGTAGCGCACCAGGTACTTCTACTGAACCGTCTGAAGGTA<br>GCGCACCAGGTACTTCTGAAAGCGCAACCCCGGAATCCGGCCCAGGTACCTCTGAA<br>AGCGCAACCCCGGAGTCCGGCCCAGGTAGCCCTGCTGGCTCTCCAACCTCCACCGA<br>AGAAGGTACCTCTGAAAGCGCAACCCCTGAATCCGGCCCAGGTAGCGAACCGGCA<br>ACCTCCGGTTCTGAAACCCCAGGTACCTCTGAAAGCGCTACTCCGGAGTCTGGCCC<br>AGGTACCTCTACTGAACCGTCTGAGGGTAGCGCTCCAGGTACTTCTACTGAACCGT<br>CCGAAGGTAGCGCACCAGGTACTTCTACCGAACCGTCGAAGGCAGCGCTCCAGGT<br>ACCTCTACTGAACCTTCCGAGGGCAGCGCTCCAGGTACCTCTACCGAACCTTCTGA<br>AGGTAGCGCACCAGGTACTTCTACCGAACCGTCCGAGGGTAGCGCACCAGGTAGC<br>CCAGCAGGTTCTCCTACCTCCACCGAGGAAGGTACTTCTACCGAACCGTCCGAGGG<br>TAGCGCACCAGGTACCTCTGAAAGCGCAACTCCTGAGTCTGGCCCAGGTAGCGAAC<br>CTGCTACCTCCGGCTCTGAGACTCCAGGTACCTCTGAAAGCGCAACCCCGGAATCT<br>GGTCCAGGTAGCGAACCTGCAACCTCTGGCTCTGAAACCCCAGGTACCTCTGAAAG<br>CGCTACTCCTGAATCGGCCCAGGTACTTCTACTGAACCGTCCGAGGGCAGCGCAC<br>CAGGTACTTCTGAAAGCGCTACTCCTGAGTCCGGCCCAGGTAGCCCGGCTGGCTCT<br>CCGACTTCCACCGAGGAAGGTAGCCCGGCTGGCTCTCCAACTTCTACTGAAGAAGG<br>TAGCCCGGCAGGCTCTCCGACCTCTACTGAGGAAGGTACTTCTGAAAGCGCAACCC<br>CGGAGTCCGGCCCAGGTACCTCTACCGAACCGTCTGAGGGCAGCGCACCAGGTACC<br>TCTGAAAGCGCAACTCCTGAGTCTGGCCCAGGTAGCGAACCTGCTACCTCCGGCTC<br>TGAGACTCCAGGTACCTCTGAAAGCGCAACCCCGGAATCTGGTCCAGGTAGCGAAC | 208 |

TABLE 10-continued

DNA sequences of XTEN and precursor sequences

| XTEN Name | DNA Sequence | SEQ ID NO: |
|---|---|---|
| | CTGCAACCTCTGGCTCTGAAACCCCAGGTACCTCTGAAAGCGCTACTCCTGAATCT<br>GGCCCAGGTACTTCTACTGAACCGTCCGAGGGCAGCGCACCAGGTAGCCCTGCTGG<br>CTCTCCAACCTCCACCGAAGAAGGTACCTCTGAAAGCGCAACCCCTGAATCCGGCC<br>CAGGTAGCGAACCGGCAACCTCCGGTTCTGAAACCCCAGGTACTTCTGAAAGCGCT<br>ACTCCTGAGTCCGGCCCAGGTAGCCCGGCTGGCTCTCCGACTTCCACCGAGGAAGG<br>TAGCCCGGCTGGCTCTCCAACTTCTACTGAAGAAGGTACTTCTACCGAACCTTCCG<br>AGGGCAGCGCACCAGGTACTTCTGAAAGCGCTACCCCTGAGTCCGGCCCAGGTACT<br>TCTGAAAGCGCTACTCCTGAATCCGGTCCAGGTACTTCTGAAAGCGCTACCCCGGA<br>ATCTGGCCCAGGTAGCGAACCGGCTACTTCTGGTTCTGAAACCCCAGGTAGCGAAC<br>CGGCTACCTCCGGTTCTGAAACTCCAGGTAGCCCAGCAGGCTCTCCGACTTCCACT<br>GAGGAAGGTACTTCTACTGAACCTTCCGAAGGCAGCGCACCAGGTACCTCTACTGA<br>ACCTTCTGAGGGCAGCGCTCCAGGTAGCGAACCTGCAACCTCTGGCTCTGAAACCC<br>CAGGTACCTCTGAAAGCGCTACTCCTGAATCTGGCCCAGGTACTTCTACTGAACCG<br>TCCGAGGGCAGCGCACCA | |
| AF864 | GGTTCTACCAGCGAATCTCCTTCTGGCACCGCTCCAGGTACCTCTCCTAGCGGCGA<br>ATCTTCTACCGCTCCAGGTTCTACTAGCGAATCTCCTTCTGGCACTGCACCAGGTTC<br>TACTAGCGAATCCCCGTCTGGTACTGCTCCAGGTACTTCTACTCCTGAAAGCGGTTC<br>CGCTTCTCCAGGTACCTCTACTCCGGAAAGCGGTTCTGCATCTCCAGGTTCTACCAG<br>CGAATCTCCTTCTGGCACCGCTCCAGGTTCTACTAGCGAATCCCCGTCTGGTACCGC<br>ACCAGGTACTTCTCCTAGCGGCGAATCTTCTACCGCACCAGGTTCTACTAGCGAAT<br>CTCCGTCTGGCACTGCTCCAGGTACTTCTCCTAGCGGTGAATCTTCTACCGCTCCAG<br>GTACTTCCCCTAGCGGCGAATCTTCTACCGCTCCAGGTTCTACTAGCTCTACTGCAG<br>AATCTCCGGGCCCAGGTACCTCTCCTAGCGGTGAATCTTCTACCGCTCCAGGTACTT<br>CTCCGAGCGGTGAATCTTCTACCGCTCCAGGTTCTACTAGCTCTACTGCAGAATCTC<br>CTGGCCCAGGTACCTCTACTCCGGAAAGCGGCTCTGCATCTCCAGGTACTTCTACCC<br>CTGAAAGCGGTTCTGCATCTCCAGGTTCTACTAGCGAATCTCCTTCTGGCACTGCAC<br>CAGGTTCTACCAGCGAATCTCCGTCTGGCACTGCACCAGGTACCTCTACCCCTGAA<br>AGCGGTTCCGCTTCTCCAGGTTCTACCAGCTCTACCGCAGAATCTCCTGGTCCAGGT<br>ACCTCTACTCCGGAAAGCGGCTCTGCATCTCCAGGTTCTACTAGCGAATCTCCTTCT<br>GGCACTGCACCAGGTACTTCTCCGAGCGGTGAATCTTCTACCGCACCAGGTTCTAC<br>TAGCTCTACCGCTGAATCTCCGGGCCCAGGTACTTCTCCGAGCGGTGAATCTTCTAC<br>TGCTCCAGGTACCTCTACTCCTGAAAGCGGTTCTGCATCTCCAGGTTCCACTAGCTC<br>TACCGCAGAATCTCCGGGCCCAGGTTCTACTAGCTCTACTGCTGAATCTCCTGGCCC<br>AGGTTCTACTAGCTCTACTGCTGAATCTCCGGGTCCAGGTTCTACCAGCTCTACTGC<br>TGAATCTCCTGGTCCAGGTACCTCCCCGAGCGGTGAATCTGTCTACTGCACCAGGTTC<br>TACTAGCGAATCTCCTTCTGGCACTGCACCAGGTTCTACCAGCGAATCTCCGTCTGG<br>CACTGCACCAGGTACCTCTACCCCTGAAAGCGGTCCXXXXXXXXXXXXXTGCAAGC<br>GCAAGCGGCGCGCCAAGCACGGGAXXXXXXXXXTAGCGAATCTCCTTCTGGTACCG<br>CTCCAGGTTCTACCAGCGAATCCCCGTCTGGTACTGCTCCAGGTTCTACCAGCGAAT<br>CTCCTTCTGGTACTGCACCAGGTTCTACTAGCGAATCTCCTTCTGGTACCGCTCCAG<br>GTTCTACCAGCGAATCCCCGTCTGGTACTGCTCCAGGTTCTACCAGCGAATCTCCTT<br>CTGGTACTGCACCAGGTACTTCTACTCCGGAAAGCGGTTCCGCATCTCCAGGTACTT<br>CTCCTAGCGGTGAATCTTCTACTGCTCCAGGTACCTCTCCTAGCGGCGAATCTTCTA<br>CTGCTCCAGGTTCTACCAGCTCTACTGCTGAATCTCCGGGTCCAGGTACTTCCCCGA<br>GCGGTGAATCTTCTACTGCACCAGGTACTTCTACTCCGGAAAGCGGTTCCGCTTCTC<br>CAGGTTCTACCAGCGAATCTCCTTCTGGCACCGCTCCAGGTTCTACTAGCGAATCCC<br>CGTCTGGTACCGCACCAGGTACTTCTCCTAGCGGCGAATCTTCTACCGCACCAGGTT<br>CTACTAGCGAATCCCCGTCTGGTACCGCACCAGGTACTTCTACCCCGGAAAGCGGC<br>TCTGCTTCTCCAGGTACTTCTACCCCGGAAAGCGGCTCCGCATCTCCAGGTTCTACT<br>AGCGAATCTCCTTCTGGTACCGCTCCAGGTACTTCTACCCCTGAAAGCGGCTCCGCT<br>TCTCCAGGTTCCACTAGCTCTACCGCTGAATCTCCGGGTCCAGGTTCTACCAGCGAA<br>TCTCCTTCTGGCACCGCTCCAGGTTCTACTAGCGAATCCCCGTCTGGTACCGCACCA<br>GGTACTTCTCCTAGCGGCGAATCTTCTACCGCACCAGGTTCTACCAGCTCTACTGCT<br>GAATCTCCGGGTCCAGGTACTTCCCCGAGCGGTGAATCTTCTACTGCACCAGGTAC<br>TTCTACTCCGGAAAGCGGTTCCGCTTCTCCAGGTACCTCCCCTAGCGGCGAATCTTC<br>TACTGCTCCAGGTACCTCTCCTAGCGGCGAATCTTCTACCGCTCCAGGTACCTCCCC<br>TAGCGGTGAATCTTCTACCGCACCAGGTTCTACTAGCTCTACTGCTGAATCTCCGGG<br>TCCAGGTTCTACCAGCTCTACTGCTGAATCTCCTGGTCCAGGTACCTCCCCGAGCGG<br>TGAATCTTCTACTGCACCAGGTTCTAGCCCTTCTGCTTCCACCGGTACCGGCCCAGG<br>TAGCTCTACTCCGTCTGGTGCAACTGCTCTCCAGGTAGCTCTACTCCGTCTGGTGC<br>AACCGGCTCCCCA<br>XXXX was inserted in two areas where no sequence<br>information is available. | 209 |
| AG864 | GGTGCTTCCCCGGGCACCAGCTCTACTGGTTCTCCAGGTTCTAGCCCGTCTGCTTCT<br>ACTGGTACTGGTCCAGGTTCTAGCCCTTCTGCTTCCACTGGTACTGGTCCAGGTACC<br>CCGGGTAGCGGTACCGCTTCTTCTTCTCCAGGTAGCTCTACTCCGTCTGGTGCTACC<br>GGCTCTCCAGGTTCTAACCCTTCTGCATCCACCGGTACCGGCCCAGGTGCTTCTCCG<br>GGCACCAGCTCTACTGGTTCTCCAGGTACCCCGGGCAGCGGTACCGCATCTTCTTCT<br>CCAGGTAGCTCTACTCCTTCTGGTGCAACTGGTTCTCCAGGTACTCCTGGCAGCGGT<br>ACCGCTTCTTCTTCTCCAGGTGCTTCTCCTGGTACTAGCTCTACTGGTTCTCCAGGTG<br>CTTCTCCGGGCACTAGCTCTACTGGTTCTCCAGGTACCCCGGGTAGCGGTACTGCTT<br>CTTCCTCTCCAGGTAGCTCTACCCCTTCTGGTGCAACCGGCTCTCCAGGTGCTTCTC | 210 |

TABLE 10-continued

DNA sequences of XTEN and precursor sequences

| XTEN Name | DNA Sequence | SEQ ID NO: |
|---|---|---|
| | CGGGCACCAGCTCTACCGGTTCTCCAGGTACCCCGGGTAGCGGTACCGCTTCTTCTT CTCCAGGTAGCTCTACTCCGTCTGGTGCTACCGGCTCTCCAGGTTCTAACCCTTCTG CATCCACCGGTACCGGCCCAGGTTCTAGCCCTTCTGCTTCCACCGGTACTGGCCCAG GTAGCTCTACCCCTTCTGGTGCTACCGGCTCCCCAGGTAGCTCTACTCCTTCTGGTG CAACTGGCTCTCAGGTGCATCTCCGGGCACTAGCTCTACTGGTTCTCCAGGTGCAT CCCCTGGCACTAGCTCTACTGGTTCTCCAGGTGCTTCTCCTGGTACCAGCTCTACTG GTTCTCCAGGTACTCCTGGCAGCGGTACCGCTTCTTCTTCTCCAGGTGCTTCTCCTG GTACTAGCTCTACTGGTTCTCCAGGTGCTTCTCCGGGCACTAGCTCTACTGGTTCTC CAGGTGCTTCCCCGGGCACTAGCTCTACCGGTTCTCCAGGTTCTAGCCCTTCTGCAT CTACTGGTACTGGCCCAGGTACTCCGGGCAGCGGTACTGCTTCTTCCTCTCCAGGTG CATCTCCGGGCACTAGCTCTACTGGTTCTCCAGGTGCATCCCCTGGCACTAGCTCTA CTGGTTCTCCAGGTGCTTCTCCTGGTACCAGCTCTACTGGTTCTCCAGGTAGCTCTA CTCCGTCTGGTGCAACCGGTTCCCCAGGTAGCTCTACTCCTTCTGGTGCTACTGGCT CCCCAGGTGCATCCCTGGCACCAGCTCTACCGGTTCTCCAGGTACCCCGGGCAGC GGTACCGCATCTTCCTCTCCAGGTAGCTCTACCCCGTCTGGTGCTACCGGTTCCCCA GGTAGCTCTACCCCGTCTGGTGCAACCGGCTCCCCAGGTAGCTCTACTCCGTCTGGT GCAACCGGCTCCCCAGGTTCTAGCCCGTCTGCTTCCACTGGTACTGGCCCAGGTGCT TCCCCGGGCACCAGCTCTACTGGTTCTCCAGGTGCATCCCGGGTACCAGCTCTACC GGTTCTCCAGGTACTCCTGGCAGCGGTACTGCATCTTCCTCTCCAGGTGCTTCTCCG GGCACCAGCTCTACTGGTTCTCCAGGTGCATCTCCGGGCACTAGCTCTACTGGTTCT CCAGGTGCATCCCTGGCACTAGCTCTACTGGTTCTCCAGGTGCTTCTCCTGGTACC AGCTCTACTGGTTCTCCAGGTACCCCTGGTAGCGGTACTGCTTCTTCCTCTCCAGGT AGCTCTACTCCGTCTGGTACCGGTTCTCCAGGTACCCCGGGTAGCGGTACCGC ATCTTCTTCTCCAGGTAGCTCTACCCCGTCTGGTGCTACTGGTTCTCCAGGTACTCC GGGCAGCGGTACTGCTTCTTCCTCTCCAGGTAGCTCTACCCCTTCTGGTGCTACTGG CTCTCCAGGTAGCTCTACCCCGTCTGGTGCTACTGGCTCCCCAGGTTCTAGCCCTTC TGCATCCACCGGTACCGGTCCAGGTTCTAGCCCGTCTGCATCTACTGGTACTGGTC AGGTGCATCCCGGGCACTAGCTCTACCGGTTCTCCAGGTACTCCTGGTAGCGGTA CTGCTTCTTCTTCTCCAGGTAGCTCTACTCCTTCTGGTGCTACTGGTTCTCCAGGTTC TAGCCCTTCTGCATCCACCGGTACCGGCCCAGGTTCTAGCCCGTCTGCTTCTACCGG TACTGGTCCAGGTGCTTCTCCGGGTACTAGCTCTACTGGTTCTCCAGGTGCATCTCC TGGTACTAGCTCTACTGGTTCTCCAGGTAGCTCTACTCCGTCTGGTGCAACCGGCTC TCCAGGTTCTAGCCCTTCTGCATCTACCGGTACTGGTCCAGGTGCATCCCTGGTAC CAGCTCTACCGGTTCTCCAGGTTCTAGCCCTTCTGCTTCTACCGGTACCGGTCCAGG TACCCCTGGCAGCGGTACCGCATCTTCCTCTCCAGGTAGCTCTACTCCGTCTGGTGC AACCGGTTCCCCAGGTAGCTCTACTCCTTCTGGTGCTACTGGCTCCCCAGGTGCATC CCCTGGCACCAGCTCTACCGGTTCTCCA | |
| AM923 | ATGGCTGAACCTGCTGGCTCTCCAACCTCCACTGAGGAAGGTGCATCCCGGGCAC CAGCTCTACCGGTTCTCCAGGTAGCTCTACCCCGTCTGGTGCTACCGGCTCTCCAG TAGCTCTACCCCGTCTGGTGCTACTGGCTCTCAGGTACTTCTACTGAACCGTCTGA AGGCAGCGCACCAGGTAGCGAACCGGCTACTTCCGGTTCTGAAACCCCAGGTAGCC CAGCAGGTTCTCCAACTTCTACTGAAGAAGGTTCTACCAGCTCTACCGCAGAATCT CCTGGTCAGGTACCTCTACTCCGGAAAGCGGCTCTGCATCTCCAGGTTCTACTAGC GAATCTCCTTCTGGCACTGCACCAGGTTCTACTAGCGAATCCCCGTCTGGTACTGCT CCAGGTACTTCTACTCCTGAAAGCGGTTCCGCTTCTCCAGGTACCTCTACTCCGGAA AGCGGTTCTGCATCTCCAGGTAGCGAACCGGCAACCTCCGGCTCTGAAACCCCAGG TACCTCTGAAAGCGCTACTCCTGAATCCGGCCCAGGTAGCCCGGCAGGTTCTCCGA CTTCCACTGAGGAAGGTACCTCTACTGAACCTTCTGAGGGCAGCGCTCCAGGTACT TCTGAAAGCGCTACCCCGGAGTCCGGTCCAGGTACTTCTACTGAACCGTCCGAAGG TAGCGCACCAGGTACTTCTACCGAACCGTCCGAGGGTAGCGCACCAGGTAGCCCAG CAGGTTCTCCTACCTCCACCGAGGAAGGTACTTCTACCGAACCGTCCGAGGGTAGC GCACCAGGTACTTCTACCGAACCTTCCGAGGGCAGCGCACCAGGTACTTCTGAAAG CGCTACCCCTGAGTCCGGCCCAGGTACTTCTGAAAGCGCTACTCCTGAATCCGGTC CAGGTACCTCTACTGAACCTTCCGAAGGCAGCGCTCCAGGTACCTCTACCGAACCG TCCGAGGGCAGCGCACCAGGTACTTCTGAAAGCGCAACCCCTGAATCCGGTCCAGG TACTTCTACTGAACCTTCCGAAGGTAGCGCTCCAGGTAGCGAACCTGCTACTTCTG GTTCTGAAACCCCAGGTAGCCCGGCTGGCTCTCCGACCTCCACCGAGGAAGGTAGC TCTACCCCGTCTGGTGCTACTGGTTCTCCAGGTACTCCGGGCAGCGGTACTGCTTCT TCCTCTCCAGGTAGCTCTACCCCTTCTGGTGCTACTGGCTCTCCAGGTACCTCTACC GAACCGTCCGAGGGTAGCGCACCAGGTACCTCTACTGAACCGTCTGAGGGTAGCGC TCCAGGTAGCGAACCGGCAACCTCCGGTTCTGAAACTCCAGGTAGCCCTGCTGGCT CTCCGACTTCTACTGAGGAAGGTAGCCCGGCTGGTTCTCCGACTTCTACTGAGGAA GGTACTTCTACCGAACCTTCCGAAGGTAGCGCTCCAGGTGCAAGCGCAAGCGGCGC GCCAAGCACGGGAGGTACTTCTGAAAGCGCTACTCCTGAGTCCGGCCCAGGTAGCC CGGCTGGCTCTCCGACTTCCACCGAGGAAGGTAGCCCGGCTGGCTCTCCAACTTCT ACTGAAGAAGGTTCTACCAGCTCTACCGCTGAATCCTGGCCCAGGTTCTACTAG CGAATCTCCGTCTGGCACCGCACCAGGTACTTCCCTAGCGGTGAATCTTCTACTGC ACCAGGTACCCCTGGCAGCGGTACCGCTTCTTCCTCTCCAGGTAGCTCTACCCCGTC TGGTGCTACTGGCTCTCCAGGTTCTAGCCCGTCTGCATCTACCGGTACCGGCCCAGG TAGCGAACCGGCAACCTCCGGCTCTGAAACTCCAGGTACTTCTGAAAGCGCTACTC CGGAATCCGGCCCAGGTAGCGAACCGGCTACTTCCGGCTCTGAAACCCCAGGTTCC ACCAGCTCTACTGCAGAATCTCCGGGCCCAGGTTCTACTAGCTCTACTGCAGAATC TCCGGGTCCAGGTACTTCTCCTAGCGGCGAATCTTCTACCGCTCCAGGTAGCGAAC | 211 |

TABLE 10-continued

DNA sequences of XTEN and precursor sequences

| XTEN Name | DNA Sequence | SEQ ID NO: |
|---|---|---|
| | CGGCAACCTCTGGCTCTGAAACTCCAGGTAGCGAACCTGCAACCTCCGGCTCTGAA<br>ACCCCAGGTACTTCTACTGAACCTTCTGAGGGCAGCGCACCAGGTTCTACCAGCTC<br>TACCGCAGAATCTCCTGGTCCAGGTACCTCTACTCCGGAAAGCGGCTCTGCATCTC<br>CAGGTTCTACTAGCGAATCTCCTTCTGGCACTGCACCAGGTACTTCTACCGAACCGT<br>CCGAAGGCAGCGCTCCAGGTACCTCTACTGAACCTTCCGAGGGCAGCGCTCCAGGT<br>ACCTCTACCGAACCTTCTGAAGGTAGCGCACCAGGTAGCTCTACTCCGTCTGGTGC<br>AACCGGCTCCCCAGGTTCTAGCCCGTCTGCTTCCACTGGTACTGGCCCAGGTGCTTC<br>CCCGGGCACCAGCTCTACTGGTTCTCCAGGTAGCGAACCTGCTACCTCCGGTTCTG<br>AAACCCCAGGTACCTCTGAAAGCGCAACTCCGGAGTCTGGTCCAGGTAGCCCTGCA<br>GGTTCTCCTACCTCCACTGAGGAAGGTAGCTCTACTCCGTCTGGTGCAACCGGCTCC<br>CCAGGTTCTAGCCCGTCTGCTTCCACTGGTACTGGCCCAGGTGCTTCCCCGGGCACC<br>AGCTCTACTGGTTCTCCAGGTACCTCTGAAAGCGCTACTCCGGAGTCTGGCCCAGG<br>TACCTCTACTGAACCGTCTGAGGGTAGCGCTCCAGGTACTTCTACTGAACCGTCCG<br>AAGGTAGCGCACCA | |
| AE912 | ATGGCTGAACCTGCTGGCTCTCCAACCTCCACTGAGGAAGGTACCCCGGGTAGCGG<br>TACTGCTTCTTCCTCTCCAGGTAGCTCTACCCCTTCTGGTGCAACCGGCTCTCCAGG<br>TGCTTCTCCGGGCACCAGCTCTACCGGTTCTCCAGGTAGCCCGGCTGGCTCTCCTAC<br>CTCTACTGAGGAAGGTACTTCTGAAAGCGCTACTCCTGAGTCTGGTCCAGGTACCT<br>CTACTGAACCGTCCGAAGGTAGCGCTCCAGGTAGCCCAGCAGGCTCTCCGACTTCC<br>ACTGAGGAAGGTACTTCTACTGAACCTTCCGAAGGCAGCGCACCAGGTACCTCTAC<br>TGAACCTTCTGAGGGCAGCGCTCCAGGTACTTCTGAAAGCGCTACCCCGGAATCTG<br>GCCCAGGTAGCGAACCGGCTACTTCTGGTTCTGAAACCCCAGGTAGCGAACCGGCT<br>ACCTCCGGTTCTGAAACTCCAGGTAGCCCGGCAGGCTCTCCGACCTCTACTGAGGA<br>AGGTACTTCTGAAAGCGCAACCCCGGAGTCCGGCCCAGGTACCTCTACCGAACCGT<br>CTGAGGGCAGCGCACCAGGTACTTCTACCGAACCGTCCGAGGGTAGCGCACCAGG<br>TAGCCCAGCAGGTTCTCCTACCTCCACCGAGGAAGGTACTTCTACCGAACCGTCCG<br>AGGGTAGCGCACCAGGTACCTCTACTGAACCTTCTGAGGGCAGCGCTCCAGGTACT<br>TCTGAAAGCGCTACCCCGGAGTCCGGTCCAGGTACTTCTACTGAACCGTCCGAAGG<br>TAGCGCACCAGGTACTTCTGAAAGCGCAACCCCTGAATCCGGTCCAGGTAGCGAAC<br>CGGCTACTTCTGGCTCTGAGACTCCAGGTACTTCTACCGAACCGTCCGAAGGTAGC<br>GCACCAGGTACTTCTACTGAACCGTCTGAAGGTAGCGCACCAGGTACTTCTGAAAG<br>CGCAACCCCGGAATCCGGCCCAGGTACCTCTGAAAGCGCAACCCCGGAGTCCGGC<br>CCAGGTAGCCCTGCTGGCTCTCCAACCTCCACCGAAGAAGGTACCTCTGAAAGCGC<br>AACCCCTGAATCCGGCCCAGGTAGCGAACCGGCAACCTCCGGTTCTGAAACCCCAG<br>GTACCTCTGAAAGCGCTACTCCGGAGTCTGGCCCAGGTACCTCTACTGAACCGTCT<br>GAGGGTAGCGCTCCAGGTACTTCTACTGAACCGTCCGAAGGTAGCGCACCAGGTAC<br>TTCTACCGAACCGTCCGAAGGCAGCGCTCCAGGTACCTCTACTGAACCTTCCGAGG<br>GCAGCGCTCCAGGTACCTCTACCGAACCTTCTGAAGGTAGCGCACCAGGTACTTCT<br>ACCGAACCGTCCGAGGGTAGCGCACCAGGTAGCCCAGCAGGTTCTCCTACCTCCAC<br>CGAGGAAGGTACTTCTACCGAACCGTCCGAGGGTAGCGCACCAGGTACCTCTGAA<br>AGCGCAACTCCTGAGTCTGGCCCAGGTAGCGAACCTGCTACCTCCGGCTCTGAGAC<br>TCCAGGTACCTCTGAAAGCGCAACCCCGGAATCTGGTCCAGGTAGCGAACCTGCAA<br>CCTCTGGCTCTGAAACCCCAGGTACCTCTGAAAGCGCTACTCCTGAATCTGGCCCA<br>GGTACTTCTACTGAACCGTCCGAGGGCAGCGCACCAGGTACTTCTGAAAGCGCTAC<br>TCCTGAGTCCGGCCCAGGTAGCCCGGCTGGCTCTCCGACTTCCACCGAGGAAGGTA<br>GCCCGGCTGGCTCTCCAACTTCTACTGAAGAAGGTAGCCCGGCAGGCTCTCCGACC<br>TCTACTGAGGAAGGTACTTCTGAAAGCGCAACCCCGGAGTCCGGCCCAGGTACCTC<br>TACCGAACCGTCTGAGGGCAGCGCACCAGGTACCTCTGAAAGCGCAACTCCTGAGT<br>CTGGCCCAGGTAGCGAACCTGCTACCTCCGGCTCTGAGACTCCAGGTACCTCTGAA<br>AGCGCAACCCCGGAATCTGGTCCAGGTAGCGAACCTGCAACCTCTGGCTCTGAAAC<br>CCCAGGTACCTCTGAAAGCGCTACTCCTGAATCTGGCCCAGGTACTTCTACTGAAC<br>CGTCCGAGGGCAGCGCACCAGGTAGCCCTGCTGGCTCTCAACCTCCACCGAAGAA<br>GGTACCTCTGAAAGCGCAACCCCTGAATCCGGCCCAGGTAGCGAACCGGCAACCTC<br>CGGTTCTGAAACCCCAGGTACTTCTGAAAGCGCTACTCCTGAGTCCGCCCAGGTA<br>GCCCGGCTGGCTCTCCGACTTCCACCGAGGAAGGTAGCCCGGCTGGCTCTCCAACT<br>TCTACTGAAGAAGGTACTTCTACCGAACCTTCCGAGGGCAGCGCACCAGGTACTTC<br>TGAAAGCGCTACCCCTGAGTCCGGCCCAGGTACTTCTGAAAGCGCTACTCCTGAAT<br>CCGGTCCAGGTACTTCTGAAAGCGCTACCCCGGAATCTGGCCCAGGTAGCGAACCG<br>GCTACTTCTGGTTCTGAAACCCCAGGTAGCGAACCGGCTACCTCCGGTTCTGAAAC<br>TCCAGGTAGCCCAGCAGGCTCTCCGACTTCCACTGAGGAAGGTACTTCTACTGAAC<br>CTTCCGAAGGCAGCGCACCAGGTACCTCTACTGAACCTTCTGAGGGCAGCGCTCCA<br>GGTAGCGAACCTGCAACCTCTGGCTCTGAAACCCCAGGTACCTCTGAAAGCGCTAC<br>TCCTGAATCTGGCCCAGGTACTTCTACTGAACCGTCCGAGGGCAGCGCACCA | 212 |
| AM1296 | GGTACTTCTACTGAACCGTCTGAAGGCAGCGCACCAGGTAGCGAACCGGCTACTTC<br>CGGTTCTGAAACCCCAGGTAGCCCAGCAGGTTCTCCAACTTCTACTGAAGAAGGTT<br>CTACCAGCTCTACCGCAGAATCTCCTGGTCCAGGTACCTCTACTCCGGAAAGCGGC<br>TCTGCATCTCCAGGTTCTACTAGCGAATCTCCTTCTGGCACTGCACCAGGTTCTACT<br>AGCGAATCCCCGTCTGGTACTGCTCCAGGTACTTCTACTCCTGAAAGCGGTTCCGCT<br>TCTCCAGGTACCTCTACTCCGGAAAGCGGTTCTGCATCTCCAGGTAGCGAACCGGC<br>AACCTCCGGCTCTGAAACCCCAGGTACCTCTGAAAGCGCTACTCCTGAATCCGGCC<br>CAGGTAGCCCGGCAGGTTCTCCGACTTCCACTGAGGAAGGTACCTCTACTGAACCT<br>TCTGAGGGCAGCGCTCCAGGTACTTCTGAAAGCGCTACCCCGGAGTCCGGTCCAGG | 213 |

TABLE 10-continued

DNA sequences of XTEN and precursor sequences

| XTEN Name | DNA Sequence | SEQ ID NO: |
|---|---|---|
| | TACTTCTACTGAACCGTCCGAAGGTAGCGCACCAGGTACTTCTACCGAACCGTCCG<br>AGGGTAGCGCACCAGGTAGCCCAGCAGGTTCTCCTACCTCCACCGAGGAAGGTACT<br>TCTACCGAACCGTCCGAGGGTAGCGCACCAGGTACTTCTACCGAACCTTCCGAGGG<br>CAGCGCACCAGGTACTTCTGAAAGCGCTACCCCTGAGTCCGGCCCAGGTACTTCTG<br>AAAGCGCTACTCCTGAATCCGGTCCAGGTACCTCTACTGAACCTTCCGAAGGCAGC<br>GCTCCAGGTACCTCTACCGAACCGTCCGAGGGCAGCGCACCAGGTACTTCTGAAAG<br>CGCAACCCCTGAATCCGGTCCAGGTACTTCTACTGAACCTTCCGAAGGTAGCGCTC<br>CAGGTAGCGAACCTGCTACTTCTGGTTCTGAAACCCCAGGTAGCCCGGCTGGCTCT<br>CCGACCTCCACCGAGGAAGGTAGCTCTACCCCGTCTGGTGCTACTGGTTCTCCAGG<br>TACTCCGGGCAGCGGTACTGCTTCTTCCTCTCCAGGTAGCTCTACCCCTTCTGGTGC<br>TACTGGCTCTCCAGGTACCTCTACCGAACCGTCCGAGGGTAGCGCACCAGGTACCT<br>CTACTGAACCGTCTGAGGGTAGCGCTCAGGTAGCGAACCGGCAACCTCCGGTTCT<br>GAAACTCCAGGTAGCCCTGCTGGCTCTCCGACTTCTACTGAGGAAGGTAGCCCGGC<br>TGGTTCTCCGACTTCTACTGAGGAAGGTACTTCTACCGAACCTTCCGAAGGTAGCG<br>CTCCAGGTCCAGAACCAACGGGGCCGGCCCCAAGCGGAGGTAGCGAACCGGCAAC<br>CTCCGGCTCTGAAACCCCAGGTACCTCTGAAAGCGCTACTCCTGAATCCGGCCCAG<br>GTAGCCCGGCAGGTTCTCCGACTTCCACTGAGGAAGGTACTTCTGAAAGCGCTACT<br>CCTGAGTCCGGCCCAGGTAGCCCGGCTGGCTCTCCGACTTCCACCGAGGAAGGTAG<br>CCCGGCTGGCTCTCCAACTTCTACTGAAGAAGGTACTTCTGAAAGCGCTACTCCTG<br>AGTCCGGCCCAGGTAGCCCGGCTGGCTCTCCGACTTCCACCGAGGAAGGTAGCCCG<br>GCTGGCTCTCCAACTTCTACTGAAGAAGGTTCTACCAGCTCTACCGCTGAATCTCCT<br>GGCCCAGGTTCTACTAGCGAATCTCCGTCTGGCACCGCACCAGGTACTTCCCCTAG<br>CGGTGAATCTTCTACTGCACCAGGTTCTACCAGCGAATCTCCTTCTGGCACCGCTCC<br>AGGTTCTACTAGCGAATCCCCGTCTGGTACCGCACCAGGTACTTCTCCTAGCGGCG<br>AATCTTCTACCGCACCAGGTACTTCTACCGAACCTTCCGAGGGCAGCGCACCAGGT<br>ACTTCTGAAAGCGCTACCCCTGAGTCCGGCCCAGGTACTTCTGAAAGCGCTACTCC<br>TGAATCCGGTCCAGGTAGCGAACCGGCAACCTCTGGCTCTGAAACCCCAGGTACCT<br>CTGAAAGCGCTACTCCGGAATCTGGTCCAGGTACTTCTGAAAGCGCTACTCCGGAA<br>TCCGGTCCAGGTACCTCTACTGAACCTTCTGAGGGCAGCGCTCCAGGTACTTCTGA<br>AAGCGCTACCCCGGAGTCCGGTCCAGGTACTTCTACTGAACCGTCCGAAGGTAGCG<br>CACCAGGTACCTCCCCTAGCGGCGAATCTTCTACTGCTCCAGGTACCTCTCCTAGCG<br>GCGAATCTTCTACCGCTCCAGGTACCTCCCCTAGCGGTGAATCTTCTACCGCACCAG<br>GTACTTCTACCGAACCGTCCGAGGGTAGCGCACCAGGTAGCCCAGCAGGTTCTCCT<br>ACCTCCACCGAGGAAGGTACTTCTACCGAACCGTCCGAGGGTAGCGCACCAGGTTC<br>TAGCCCTTCTGCTTCCACCGGTACCGGCCCAGGTAGCTCTACTCCGTCTGGTGCAAC<br>TGGCTCTCCAGGTAGCTCTACTCCGTCTGGTGCAACCGGCTCCCCAGGTAGCTCTAC<br>CCCGTCTGGTGCTACCGGCTCTCCAGGTAGCTCTACCCCGTCTGGTGCAACCGGCTC<br>CCCAGGTGCATCCCCGGGTACTAGCTCTACCGGTTCTCCAGGTGCAAGCGCAAGCG<br>GCGCGCCAAGCACGGGAGGTACTTCTCCGAGCGGTGAATCTTCTACCGCACCAGGT<br>TCTACTAGCTCTACCGCTGAATCTCCGGGCCCAGGTACTTCTCCGAGCGGTGAATCT<br>TCTACTGCTCCAGGTACCTCTGAAAGCGCTACTCCGGAGTCTGGCCCAGGTACCTCT<br>ACTGAACCGTCTGAGGGTAGCGCTCCAGGTACTTCTACTGAACCGTCCGAAGGTAG<br>CGCACCAGGTTCTAGCCCTTCTGCATCTACTGGTACTGGCCCAGGTAGCTCTACTCC<br>TTCTGGTGCTACCGGCTCTCCAGGTGCTTCTCCGGGTACTAGCTCTACCGGTTCTCC<br>AGGTACTTCTACTCCGGAAAGCGGTTCCGCATCTCCAGGTACTTCTCCTAGCGGTG<br>AATCTTCTACTGCTCCAGGTACCTCTCCTAGCGGCGAATCTTCTACTGCTCCAGGTA<br>CTTCTGAAAGCGCAACCCCTGAATCCGGTCCAGGTAGCGAACCGGCTACTTCTGGC<br>TCTGAGACTCCAGGTACTTCTACCGAACCGTCCGAAGGTAGCGCACCAGGTTCTAC<br>CAGCGAATCCCCTTCTGGTACTGCTCCAGGTTCTACCAGCGAATCCCCTTCTGGCAC<br>CGCACCAGGTACTTCTACCCCTGAAAGCGGCTCCGCTTCTCCAGGTAGCCCGGCAG<br>GCTCTCCGACCTCTACTGAGGAAGGTACTTCTGAAAGCGCAACCCCGGAGTCCGGC<br>CCAGGTACCTCTACCGAACCGTCTGAGGGCAGCGCACCAGGTAGCCCTGCTGGCTC<br>TCCAACCTCCACCGAAGAAGGTACCTCTGAAAGCGCAACCCCTGAATCCGGCCCAG<br>GTAGCGAACCGGCAACCTCCGGTTCTGAAACCCCAGGTAGCTCTACCCCGTCTGGT<br>GCTACCGGTTCCCCAGGTGCTTCTCCTGGTACTAGCTCTACCGGTTCTCCAGGTAGC<br>TCTACCCGTCTGGTGCTACTGGCTCTCCAGGTTCTACTAGCGAATCCCCGTCTGGT<br>ACTGCTCCAGGTACTTCCCCTAGCGGTGAATCTTCTACTGCTCCAGGTTCTACCAGC<br>TCTACCGCAGAATCTCCGGGTCCAGGTAGCTCTACCCCTTCTGGTGCAACGGCTCT<br>CCAGGTGCATCCCCGGGTACCAGCTCTACCGGTTCTCCAGGTACTCCGGGTAGCGG<br>TACCGCTTCTTCCTCTCCAGGTAGCCCTGCTGGCTCTCCGACTTCTACTGAGGAAGG<br>TAGCCCGGCTGGTTCTCCGACTTCTACTGAGGAAGGTACTTCTACCGAACCTTCCGA<br>AGGTAGCGCTCCA | |
| BC864 | GGTACTTCCACCGAACCATCCGAACCAGGTAGCGCAGGTACTTCCACCGAACCATC<br>CGAACCTGGCAGCGCAGGTAGCGAACCGGCAACCTCTGGTACTGAACCATCAGGT<br>AGCGGCGCATCCGAGCCTACCTCTACTGAACCAGGTAGCGAACCGGCTACCTCCGG<br>TACTGAGCCATCAGGTAGCGAACCGGCAACTTCCGGTACTGAACCATCAGGTAGCG<br>AACCGGCAACTTCCGGCACTGAACCATCAGGTAGCGGTGCATCTGAGCCGACCTCT<br>ACTGAACCAGGTACTTCTACTGAACCATCTGAGCCGGGCAGCGCAGGTAGCGAACC<br>AGCTACTTCTGGCACTGAACCATCAGGTACTTCTACTGAACCATCCGAACCAGGTA<br>GCGCAGGTAGCGAACCTGCTACCTCTGGTACTGAGCCATCAGGTAGCGAACCGGCT<br>ACCTCTGGTACTGAACCATCAGGTACTTCTACCGAACCATCCGAGCCTGGTAGCGC<br>AGGTACTTCTACCGAACCATCCGAGCCAGGCAGCGCAGGTAGCGAACCGGCAACC<br>TCTGGCACTGAGCCATCAGGTAGCGAACCAGCAACTTCTGGTACTGAACCATCAGG | 214 |

TABLE 10-continued

DNA sequences of XTEN and precursor sequences

| XTEN Name | DNA Sequence | SEQ ID NO: |
|---|---|---|
| | TACTAGCGAGCCATCTACTTCCGAACCAGGTGCAGGTAGCGGCGCATCCGAACCTA CTTCCACTGAACCAGGTACTAGCGAGCCATCCACCTCTGAACCAGGTGCAGGTAGC GAACCGGCAACTTCCGGCACTGAACCATCAGGTAGCGAACCGGCTACCTCTGGTAC TGAACCATCAGGTACTTCTACCGAACCATCCGAGCCTGGTAGCGCAGGTACTTCTA CCGAACCATCCGAGCCAGGCAGCGCAGGTAGCGGTGCATCCGAGCCGACCTCTACT GAACCAGGTAGCGAACCAGCAACTTCTGGCACTGAGCCATCAGGTAGCGAACCAG CTACCTCTGGTACTGAACCATCAGGTAGCGAACCGGCTACTTCCGGCACTGAACCA TCAGGTAGCGAACCAGCAACCTCCGGTACTGAACCATCAGGTACTTCCACTGAACC ATCCGAACCGGGTAGCGCAGGTAGCGAACCGGCAACTTCCGGCACTGAACCATCA GGTAGCGGTGCATCTGAGCCGACCTCTACTGAACCAGGTACTTCTACTGAACCATC TGAGCCGGGCAGCGCAGGTAGCGAACCTGCAACCTCCGGCACTGAGCCATCAGGT AGCGGCGCATCTGAACCAACCTCTACTGAACCAGGTACTTCCACCGAACCATCTGA GCCAGGCAGCGCAGGTAGCGGCGCATCTGAACCAACCTCTACTGAACCAGGTAGC GAACCAGCAACTTCTGGTACTGAACCATCAGGTAGCGGCGCATCTGAGCCTACTTC CACTGAACCAGGTAGCGAACCGGCAACTTCCGGCACTGAACCATCAGGTAGCGGT GCATCTGAGCCGACCTCTACTGAACCAGGTACTTCTACTGAACCATCTGAGCCGGG CAGCGCAGGTAGCGAACCGGCAACTTCCGGCACTGAACCATCAGGTAGCGGTGCA TCTGAGCCGACCTCTACTGAACCAGGTACTTCTACTGAACCATCTGAGCCGGGCAG CGCAGGTAGCGAACCAGCTACTTCTGGCACTGAACCATCAGGTACTTCTACTGAAC CATCCGAACCAGGTAGCGCAGGTAGCGAACCTGCTACCTCTGGTACTGAGCCATCA GGTACTTCTACTGAACCATCCGAGCCGGGTAGCGCAGGTACTTCCACTGAACCATC TGAACCTGGTAGCGCAGGTACTTCCACTGAACCATCCGAACCAGGTAGCGCAGGTA CTTCTACTGAACCATCCGAGCCGGGTAGCGCAGGTACTTCCACTGAACCATCTGAA CCTGGTAGCGCAGGTACTTCCACTGAACCATCCGAACCAGGTAGCGCAGGTACTAG CGAACCATCCACCTCCGAACCAGGCGCAGGTAGCGGTGCATCTGAACCGACTTCTA CTGAACCAGGTACTTCCACTGAACCATCTGAGCCAGGTAGCGCAGGTACTTCCACC GAACCATCCGAACCAGGTAGCGCAGGTACTTCCACCGAACCATCCGAACCTGGCA GCGCAGGTAGCGAACCGGCAACCTCTGGTACTGAACCATCAGGTAGCGGTGCATCC GAGCCGACCTCTACTGAACCAGGTAGCGAACCAGCAACTTCTGGCACTGAGCCATC AGGTAGCGAACCAGCTACCTCTGGTACTGAACCATCAGGTAGCGAACCGGCAACCT CTGGCACTGAGCCATCAGGTAGCGAACCAGCAACTTCTGGTACTGAACCATCAGGT ACTAGCGAGCCATCTACTTCCGAACCAGGTGCAGGTAGCGAACCTGCAACCTCCGG CACTGAGCCATCAGGTAGCGGCGCATCTGAACCAACCTCTACTGAACCAGGTACTT CCACCGAACCATCTGAGCCAGGCAGCGCAGGTAGCGAACCTGCAACCTCCGGCAC TGAGCCATCAGGTAGCGGCGCATCTGAACCAACCTCTACTGAACCAGGTACTTCCA CCGAACCATCTGAGCCAGGCAGCGCA | |
| BD864 | GGTAGCGAAACTGCTACTTCCGGCTCTGAGACTGCAGGTACTAGTGAATCCGCAAC TAGCGAATCTGGCGCAGGTAGCACTGCAGGCTCTGAGACTTCCACTGAAGCAGGTA CTAGCGAGTCCGCAACCAGCGAATCCGGCGCAGGTAGCGAAACTGCTACCTCTGGC TCCGAGACTGCAGGTAGCGAAACTGCAACCTCTGGCTCTGAAACTGCAGGTACTTC CACTGAAGCAAGTGAAGGCTCCGCATCAGGTACTTCCACCGAAGCAAGCGAAGGC TCCGCATCAGGTACTAGTGAGTCCGCAACTAGCGAATCCGGTGCAGGTAGCGAAAC CGCTACCTCTGGTTCCGAAACTGCAGGTACTTCTACCGAGGCTAGCGAAGGTTCTG CATCAGGTAGCACTGCTGGTTCCGAGACTTCTACTGAAGCAGGTACTAGCGAATCT GCTACTAGCGAATCCGGCGCAGGTACTAGCGAATCCGCTACCAGCGAATCCGGCGC AGGTAGCGAAACTGCAACCTCTGGTTCCGAGACTGCAGGTACTAGCGAGTCCGCTA CTAGCGAATCTGGCGCAGGTACTTCCACTGAAGCTAGTGAAGGTTCTGCATCAGGT AGCGAAACTGCTACTTCTGGTTCCGAAACTGCAGGTAGCGAAACCGCTACCTCTGG TTCCGAAACTGCAGGTACTTCTACCGAGGCTAGCGAAGGTTCTGCATCAGGTAGCA CTGCTGGTTCCGAGACTTCTACTGAAGCAGGTACTAGCGAGTCCGCTACTAGCGAA TCTGGCGCAGGTACTTCCACTGAAGCTAGTGAAGGTTCTGCATCAGGTAGCGAAAC TGCTACTTCTGGTTCCGAAACTGCAGGTAGCACTGCTGGCTCCGAGACTTCTACCG AAGCAGGTAGCACTGCAGGTTCCGAAACTTCCACTGAAGCAGGTAGCGAAACTGC TACCTCTGGCTCTGAGACTGCAGGTACTAGCGAATCTGCTACTAGCGAATCCGGCG CAGGTACTAGCGAATCCGCTACCAGCGAATCCGGCGCAGGTAGCGAAACTGCAAC CTCTGGTTCCGAGACTGCAGGTACTAGCGAATCTGCTACTAGCGAATCCGGCGCAG GTACTAGCGAATCCGCTACCAGCGAATCCGGCGCAGGTAGCGAAACTGCAACCTCT GGTTCCGAGACTGCAGGTAGCGAAACCGCTACCTCTGGTTCCGAAACTGCAGGTAC TTCTACCGAGGCTAGCGAAGGTTCTGCATCAGGTAGCACTGCTGGTTCCGAGACTT CTACTGAAGCAGGTAGCGAAACTGCTACTTCCGGCTCTGAGACTGCAGGTACTAGT GAATCCGCAACTAGCGAATCTGGCGCAGGTAGCACTGCAGGCTCTGAGACTTCCAC TGAAGCAGGTAGCACTGCTGGTTCCGAAACCTCTACCGAAGCAGGTAGCACTGCAG GTTCTGAAACCTCCACTGAAGCAGGTACTTCCACTGAGGCTAGTGAAGGCTCTGCA TCAGGTAGCACTGCTGGTTCCGAAACCTCTACCGAAGCAGGTAGCACTGCAGGTTC TGAAACCTCCACTGAAGCAGGTACTTCCACTGAGGCTAGTGAAGGCTCTGCATCAG GTAGCACTGCAGGTTCTGAGACTTCCACCGAAGCAGGTAGCGAAACTGCTACTTCT GGTTCCGAAACTGCAGGTACTTCCACTGAAGCTAGTGAAGGTTCCGCATCAGGTAC TAGTGAGTCCGCAACCAGCGAATCCGGCGCAGGTAGCGAAACCGCAACCTCCGGT TCTGAAACTGCAGGTACTAGCGAATCCGCAACCAGCGAATCTGGCGCAGGTACTAG TGAGTCCGCAACCAGCGAATCCGGCGCAGGTAGCGAAACCGCAACCTCCGGTTCTG AAACTGCAGGTACTAGCGAATCCGCAACCAGCGAATCTGGCGCAGGTAGCGAAAC TGCTACTTCCGGCTCTGAGACTGCAGGTACTTCCACCGAAGCAAGCGAAGGTTCCG CATCAGGTACTTCCACCGAGGCTAGTGAAGGCTCTGCATCAGGTAGCACTGCTGGC | 215 |

TABLE 10-continued

DNA sequences of XTEN and precursor sequences

| XTEN Name | DNA Sequence | SEQ ID NO: |
|---|---|---|
| | TCCGAGACTTCTACCGAAGCAGGTAGCACTGCAGGTTCCGAAACTTCCACTGAAGC<br>AGGTAGCGAAACTGCTACCTCTGGCTCTGAGACTGCAGGTACTAGCGAATCTGCTA<br>CTAGCGAATCCGGCGCAGGTACTAGCGAATCCGCTACCAGCGAATCCGGCGCAGG<br>TAGCGAAACTGCAACCTCTGGTTCCGAGACTGCAGGTAGCGAAACTGCTACTTCCG<br>GCTCCGAGACTGCAGGTAGCGAAACTGCTACTTCTGGCTCCGAAACTGCAGGTACT<br>TCTACTGAGGCTAGTGAAGGTTCCGCATCAGGTACTAGCGAGTCCGCAACCAGCGA<br>ATCCGGCGCAGGTAGCGAAACTGCTACCTCTGGCTCCGAGACTGCAGGTAGCGAA<br>ACTGCAACCTCTGGCTCTGAAACTGCAGGTACTAGCGAATCTGCTACTAGCGAATC<br>CGGCGCAGGTACTAGCGAATCCGCTACCAGCGAATCCGGCGCAGGTAGCGAAACT<br>GCAACCTCTGGTTCCGAGACTGCA | |

One may clone the library of XTEN-encoding genes into one or more expression vectors known in the art. To facilitate the identification of well-expressing library members, one can construct the library as fusion to a reporter protein. Non-limiting examples of suitable reporter genes are green fluorescent protein, luciferace, alkaline phosphatase, and beta-galactosidase. By screening, one can identify short XTEN sequences that can be expressed in high concentration in the host organism of choice. Subsequently, one can generate a library of random XTEN dimers and repeat the screen for high level of expression. Subsequently, one can screen the resulting constructs for a number of properties such as level of expression, protease stability, or binding to antiserum.

One aspect of the invention is to provide polynucleotide sequences encoding the components of the fusion protein wherein the creation of the sequence has undergone codon optimization. Of particular interest is codon optimization with the goal of improving expression of the polypeptide compositions and to improve the genetic stability of the encoding gene in the production hosts. For example, codon optimization is of particular importance for XTEN sequences that are rich in glycine or that have repetitive amino acid sequences. Codon optimization can be performed using computer programs (Gustafsson, C., et al. (2004) Trends Biotechnol, 22: 346-53), some of which minimize ribosomal pausing (Coda Genomics Inc.). In one embodiment, one can perform codon optimization by constructing codon libraries where all members of the library encode the same amino acid sequence but where codon usage is varied. Such libraries can be screened for highly expressing and genetically stable members that are particularly suitable for the large-scale production of XTEN-containing products. When designing XTEN sequences one can consider a number of properties. One can minimize the repetitiveness in the encoding DNA sequences. In addition, one can avoid or minimize the use of codons that are rarely used by the production host (e.g. the AGG and AGA arginine codons and one leucine codon in E. coli). In the case of E. coli, two glycine codons, GGA and GGG, are rarely used in highly expressed proteins. Thus codon optimization of the gene encoding XTEN sequences can be very desirable. DNA sequences that have a high level of glycine tend to have a high GC content that can lead to instability or low expression levels. Thus, when possible, it is preferred to choose codons such that the GC-content of XTEN-encoding sequence is suitable for the production organism that will be used to manufacture the XTEN.

Optionally, the full-length XTEN-encoding gene may comprise one or more sequencing islands. In this context, sequencing islands are short-stretch sequences that are distinct from the XTEN library construct sequences and that include a restriction site not present or expected to be present in the full-length XTEN-encoding gene. In one embodiment, a sequencing island is the sequence 5'-AGGTGCAAGCG-CAAGCGGCGCGCCAAGCACGGGAGGT-3' (SEQ ID NO: 216). In another embodiment, a sequencing island is the sequence 5'-AGGTCCAGAACCAACGGGGCCGGC-CCCAAGCGGAGGT-3' (SEQ ID NO: 217).

As an alternative, one can construct codon libraries where all members of the library encode the same amino acid sequence but where codon usage is varied. Such libraries can be screened for highly expressing and genetically stable members that are particularly suitable for the large-scale production of XTEN-containing products.

Optionally, one can sequence clones in the library to eliminate isolates that contain undesirable sequences. The initial library of short XTEN sequences can allow some variation in amino acid sequence. For instance one can randomize some codons such that a number of hydrophilic amino acids can occur in a particular position.

During the process of iterative multimerization one can screen the resulting library members for other characteristics like solubility or protease resistance in addition to a screen for high-level expression.

Figure 6A:
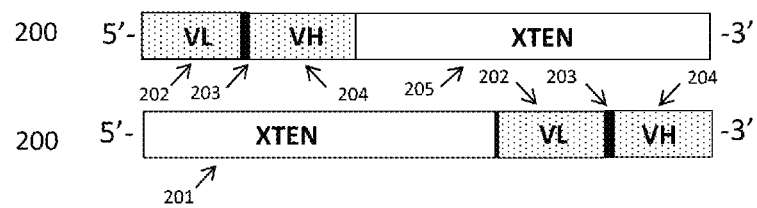
FIG. 6A shows the configuration of a gene encoding scFv binding fusion proteins (100) in two configurations (5' to 3') with a single targeting moiety, with the first having nucleotides encoding a VL binding domain sequence (202), a linker sequence (203), a VH binding domain sequence (204), and an XTEN carrier sequence (205) at the 3'-end. Below that is the opposite configuration, with nucleotides encoding an N-terminal XTEN (201), linked to nucleotides encoding a VL binding domain sequence (202), a linker sequence (203), and a VH binding domain sequence.
Figure 6B:
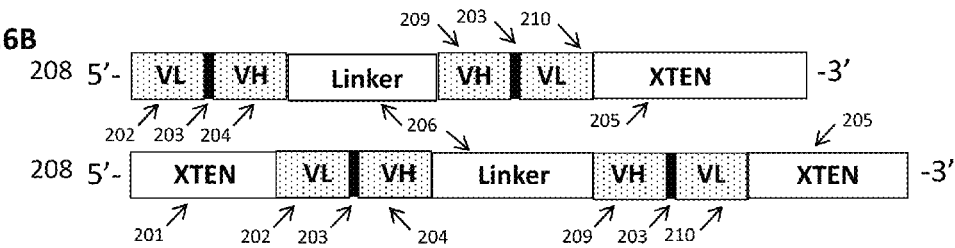
FIG. 6B shows the configuration of a gene encoding a diabody binding fusion protein that can form two antigen binding sites (208), with the top construct shown comprising, at the 5' end, genes for a first VL binding domain sequence (202), a short linker sequence joining the adjacent VL and VH genes (303), a first VH binding domain sequence (204), a second linker sequence (that can be an XTEN) joining the first and the second targeting moieties (206), a second VH binding domain (209), a second VL binding domain (210) and an XTEN carrier sequence (205) at the 3' end. The lower gene encodes, at the 5' end, an N-terminal XTEN (201), a first VL binding domain sequence (202), a short linker sequence joining the adjacent VL and VH genes (203), a first VH binding domain sequence (204), a second linker sequence (than can be an XTEN) joining the first and the second targeting moieties (206), a second VH binding domain (209), a second VL binding domain (210) and an XTEN carrier sequence (205) at the 3' end.
Figure 6C:
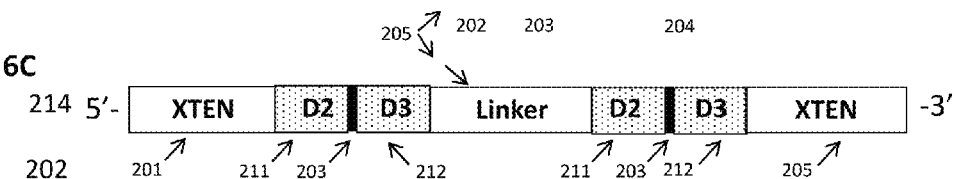
FIG. 6C shows the configuration of a gene encoding a cytokine binding protein. The gene encodes, at the 5' end, an N-terminal XTEN (201), a first D2 binding domain sequence (211), a short linker sequence joining the adjacent domain genes (203), a first D3 binding domain sequence (212), a second linker sequence (206) (than can be an XTEN) joining the first and the second targeting moieties, a second D2 binding domain (211), a second D3 binding domain (212) and an XTEN carrier sequence (205) at the 3' end.
Figure 6D:
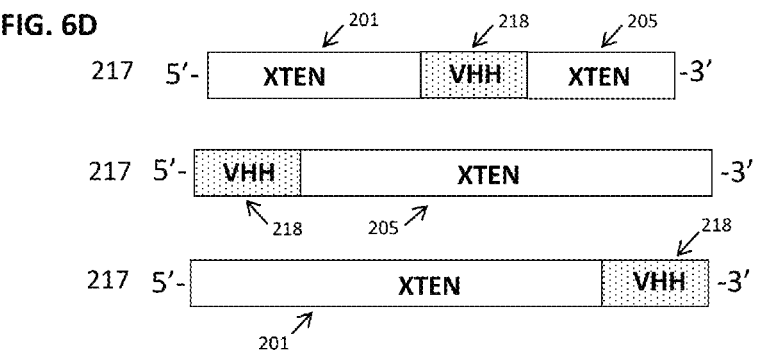
FIG. 6D shows three configurations, 5' to 3', of genes encoding a domain antibody binding fusion protein (217). The genes encode, where shown, an N-terminal XTEN (201), the VHH binding domain sequence (218), and an XTEN carrier sequence (205) at the 3' end.

In one embodiment of a construct encoding a binding fusion protein, once the gene that encodes the XTEN of desired length and properties is selected, it is genetically fused to the nucleotides encoding the N- and/or the C-terminus of the targeting moiety gene(s) by cloning it into the construct adjacent and in frame with the gene coding for the targeting moiety or adjacent to a linker sequence. The invention provides various permutations of the foregoing, depending on the binding fusion protein to be encoded. For example, a gene encoding a binding fusion protein comprising two targeting moieties such as embodied by formula II, as depicted above, would have polynucleotides encoding two targeting moieties, a linker, at least a first XTEN, and optionally a second XTEN. The step of cloning the targeting moiety genes into the XTEN construct can occur through a ligation or multimerization step. As shown in FIG. 6, the constructs encoding binding fusion proteins can be designed in different configurations of the components; e.g., XTEN 205, VL 202, VH 204 and linker sequences 203 or 206. In one embodiment, as illustrated in FIG. 6A, the construct comprises polynucleotide sequences complementary to, or those that encode a monomeric polypeptide of components in the following order (5' to 3') VL 202, linker 203, VH 204, and XTEN 205, or the reverse order. As will be apparent to those of skill in the art, in view of the disclosure and FIG. 6, other permutations or combinations of the foregoing are possible.

The invention also encompasses polynucleotides comprising XTEN-encoding polynucleotide variants that have a high percentage of sequence identity to (a) a polynucleotide sequence from Table 10, or (b) sequences that are complementary to the polynucleotides of (a). A polynucleotide with a high percentage of sequence identity is one that has at least about an 80% nucleic acid sequence identity, alternatively at least about 81%, alternatively at least about 82%, alternatively at least about 83%, alternatively at least about 84%, alternatively at least about 85%, alternatively at least about 86%, alternatively at least about 87%, alternatively at least about 88%, alternatively at least about 89%, alternatively at least about 90%, alternatively at least about 91%, alternatively at least about 92%, alternatively at least about 93%, alternatively at least about 94%, alternatively at least about 95%, alternatively at least about 96%, alternatively at least about 97%, alternatively at least about 98%, and alternatively at least about 99% nucleic acid sequence identity to (a) or (b) of the foregoing, or that can hybridize with the target polynucleotide or its complement under stringent conditions.

Homology, sequence similarity or sequence identity of nucleotide or amino acid sequences may also be determined conventionally by using known software or computer programs such as the BestFit or Gap pairwise comparison programs (GCG Wisconsin Package, Genetics Computer Group, 575 Science Drive, Madison, Wis. 53711). BestFit uses the local homology algorithm of Smith and Waterman (Advances in Applied Mathematics. 1981. 2: 482-489), to find the best segment of identity or similarity between two sequences. Gap performs global alignments: all of one sequence with all of another similar sequence using the method of Needleman and Wunsch, (Journal of Molecular Biology. 1970. 48:443-453). When using a sequence alignment program such as BestFit, to determine the degree of sequence homology, similarity or identity, the default setting may be used, or an appropriate scoring matrix may be selected to optimize identity, similarity or homology scores.

Nucleic acid sequences that are "complementary" are those that are capable of base-pairing according to the standard Watson-Crick complementarity rules. As used herein, the term "complementary sequences" means nucleic acid sequences that are substantially complementary, as may be assessed by the same nucleotide comparison set forth above, or as defined as being capable of hybridizing to the polynucleotides that encode the binding fusion protein sequences under stringent conditions, such as those described herein.

The resulting polynucleotides encoding the binding fusion protein chimeric compositions can then be individually cloned into an expression vector. The nucleic acid sequence may be inserted into the vector by a variety of procedures. In general, DNA is inserted into an appropriate restriction endonuclease site(s) using techniques known in the art. Vector components generally include, but are not limited to, one or more of a signal sequence, an origin of replication, one or more marker genes, an enhancer element, a promoter, and a transcription termination sequence. Construction of suitable vectors containing one or more of these components employs standard ligation techniques that are known to the skilled artisan. Such techniques are well known in the art and well described in the scientific and patent literature.

Various vectors are publicly available. The vector may, for example, be in the form of a plasmid, cosmid, viral particle, or phage. Both expression and cloning vectors contain a nucleic acid sequence that enables the vector to replicate in one or more selected host cells. Such vector sequences are well known for a variety of bacteria, yeast, and viruses. Useful expression vectors that can be used include, for example, segments of chromosomal, non-chromosomal and synthetic DNA sequences. Suitable vectors include, but are not limited to, derivatives of SV40 and pcDNA and known bacterial plasmids such as col EI, pCR1, pBR322, pMal-C2, pET, pGEX as described by Smith, et al., Gene 57:31-40 (1988), pMB9 and derivatives thereof, plasmids such as RP4, phage DNAs such as the numerous derivatives of phage I such as NM98 9, as well as other phage DNA such as M13 and filamentous single stranded phage DNA; yeast plasmids such as the 2 micron plasmid or derivatives of the 2m plasmid, as well as centomeric and integrative yeast shuttle vectors; vectors useful in eukaryotic cells such as vectors useful in insect or mammalian cells; vectors derived from combinations of plasmids and phage DNAs, such as plasmids that have been modified to employ phage DNA or the expression control sequences; and the like. The requirements are that the vectors are replicable and viable in the host cell of choice. Low- or high-copy number vectors may be used as desired.

Promoters suitable for use in expression vectors with prokaryotic hosts include the β-lactamase and lactose promoter systems [Chang et al., Nature, 275:615 (1978); Goeddel et al., Nature, 281:544 (1979)], alkaline phosphatase, a tryptophan (trp) promoter system [Goeddel, Nucleic Acids Res., 8:4057 (1980); EP 36,776], and hybrid promoters such as the tac promoter [deBoer et al., Proc. Natl. Acad. Sci. USA, 80:21-25 (1983)]. Promoters for use in bacterial systems can also contain a Shine-Dalgarno (S.D.) sequence operably linked to the DNA encoding binding fusion protein.

For example, in a baculovirus expression system, both non-fusion transfer vectors, such as, but not limited to pVL941 (BamHI cloning site, available from Summers, et al., Virology 84:390-402 (1978)), pVL1393 (BamHI, SmaI, XbaI, EcoRI, IVotI, XmaIII, BglII and PstI cloning sites; Invitrogen), pVL1392 (BglII, PstI, NotI, XmaIII, EcoRI, XbaII, SmaI and BamHI cloning site; Summers, et al., Virology 84:390-402 (1978) and Invitrogen) and pBlueBacIII (BamHI, BglIII, PstI, NcoI and Hindi II cloning site, with blue/white recombinant screening, Invitrogen), and fusion transfer vectors such as, but not limited to, pAc7 00 (BamHI and KpnI cloning sites, in which the BamHI recognition site begins with the initiation codon; Summers, et al., Virology 84:390-402 (1978)), pAc701 and pAc70-2 (same as pAc700, with different reading frames), pAc360 [BamHI cloning site 36 base pairs downstream of a polyhedrin initiation codon; Invitrogen (1995)) and pBlueBacHisA, B, C (three different reading frames with BamH I, BgI II, PstI, Nco l and Hind III cloning site, an N-terminal peptide for ProBond purification and blue/white recombinant screening of plaques; Invitrogen (220) can be used.

Schematics of exemplary plasmids containing one or more of the components described above are illustrated in FIG. 10.

Mammalian expression vectors can comprise an origin of replication, a suitable promoter and enhancer, and also any necessary ribosome binding sites, polyadenylation site, splice donor and acceptor sites, transcriptional termination sequences, and 5' flanking nontranscribed sequences. DNA sequences derived from the SV40 splice, and polyadenylation sites may be used to provide the required nontranscribed genetic elements. Mammalian expression vectors contemplated for use in the invention include vectors with inducible promoters, such as the dihydrofolate reductase promoters, any expression vector with a DHFR expression cassette or a DHFR/methotrexate co-amplification vector such as pED (PstI, SaiI, SbaI, SmaI and EcoRI cloning sites, with the vector expressing both the cloned gene and DHFR; Randal J. Kaufman, 1991, Randal J. Kaufman, Current Protocols in Molecular Biology, 16,12 (1991)). Alternatively a glutamine synthetase/methionine sulfoximine co-amplification vector, such as pEE14 (HindIII, XbaI, SmaI, SbaI, EcoRI and SeII cloning sites in which the vector expresses glutamine synthetase and the cloned gene; Celltech). A vector that directs episomal expression under the control of the Epstein Barr Virus (EBV) or nuclear antigen (EBNA) can be used such as pREP4 (BamHI r SfH, XhoI, NotI, NheI, HindI II, NheI, PvuII and KpnI cloning sites, constitutive RSV-LTR promoter, hygromycin selectable marker; Invitrogen), pCEP4 (BamHI, SfH, XhoI, NotI, NheI, HindIII, NheI, PvuII and KpnI cloning sites, constitutive hCMV immediate early gene promoter, hygromycin selectable marker; Invitrogen), pMEP4 (.KpnI, PvuI, NheI, HindIII, NotI, XhoI, SfiI, BamHI cloning sites, inducible methallothionein H a gene promoter, hygromycin selectable marker, Invitrogen), pREP8 (BamHI, XhoI, NotI, HindIII, NheI and KpnI cloning sites, RSV-LTR promoter, histidinol selectable marker; Invitrogen), pREP9 (KpnI, NheI, Hind III, NotI, Xho 1, Sfi 1, BamH I cloning sites, RSV-LTR promoter, G418 selectable marker; Invitrogen), and pEBVHis (RSV-LTR promoter, hygromycin selectable marker, N-terminal peptide purifiable via ProBond resin and cleaved by enterokinase; Invitrogen).

Selectable mammalian expression vectors for use in the invention include, but are not limited to, pRc/CMV (Hind III, BstXI, NotI, SbaI and ApaI cloning sites, G418 selection, Invitrogen), pRc/RSV (Hind II, SpeI, BstXI, NotI, XbaI cloning sites, G418 selection, Invitrogen) and the like. Vaccinia virus mammalian expression vectors (see, for example, Randall J. Kaufman, Current Protocols in Molecular Biology 16.12 (Frederick M. Ausubel, et al., eds. Wiley 1991) that can be used in the present invention include, but are not limited to, pSC11 (SmaI cloning site, TK- and beta-gal selection), pMJ601 (Sal 1, Sma 1, A fII, NarI, BspMII, BamHI, ApaI, NheI, SacII, KpnII and HindIII cloning sites; TK- and -gal selection), pTKgptF1S (EcoRI, PstI, SaIII AccI, HindII, SbaI, BamHI and Hpa cloning sites, TK or XPRT selection) and the like.

Yeast expression systems that can also be used in the present invention include, but are not limited to, the non-fusion pYES2 vector (XJbaI, SphI, ShoI, NotI, GstXI, EcoRI, BstXI, BamHI, SadI, KpnI and HindIII cloning sites, Invitrogen), the fusion pYESHisA, B, C (XbaII, SphI, ShoI, NotI, BstXI, EcoRI, BamHI, SadI, KpnI and HindI II cloning sites, N-terminal peptide purified with ProBond resin and cleaved with enterokinase; Invitrogen), pRS vectors and the like.

In addition, the expression vector containing the chimeric binding fusion protein-encoding polynucleotide molecule may include drug selection markers. Such markers aid in cloning and in the selection or identification of vectors containing chimeric DNA molecules. For example, genes that confer resistance to neomycin, puromycin, hygromycin, dihydrofolate reductase (DHFR) inhibitor, guanine phosphoribosyl transferase (GPT), zeocin, and histidinol are useful selectable markers. Alternatively, enzymes such as herpes simplex virus thymidine kinase (tk) or chloramphenicol acetyltransferase (CAT) may be employed. Immunologic markers also can be employed. Any known selectable marker may be employed so long as it is capable of being expressed simultaneously with the nucleic acid encoding a gene product. Further examples of selectable markers are well known to one of skill in the art and include reporters such as enhanced green fluorescent protein (EGFP), beta-galactosidase (β-gal) or chloramphenicol acetyltransferase (CAT).

In one embodiment, the polynucleotide encoding a binding fusion protein composition can be fused C-terminally to an N-terminal signal sequence appropriate for the expression host system. Signal sequences are typically proteolytically removed from the protein during the translocation and secretion process, generating a defined N-terminus. A wide variety of signal sequences have been described for most expression systems, including bacterial, yeast, insect, and mammalian systems. A non-limiting list of preferred examples for each expression system follows herein. Preferred signal sequences are OmpA, PhoA, and DsbA for $E.$ $coli$ expression. Signal peptides preferred for yeast expression are ppL-alpha, DEX4, invertase signal peptide, acid phosphatase signal peptide, CPY, or INU1. For insect cell expression the preferred signal sequences are sexta adipokinetic hormone precursor, CP1, CP2, CP3, CP4, TPA, PAP, or gp67. For mammalian expression the preferred signal sequences are IL2L, SV40, IgG kappa and IgG lambda.

In another embodiment, a leader sequence, potentially comprising a well-expressed, independent protein domain, can be fused to the N-terminus of the binding fusion protein sequence, separated by a protease cleavage site. While any leader peptide sequence that does not inhibit cleavage at the designed proteolytic site can be used, sequences in preferred embodiments will comprise stable, well-expressed sequences such that expression and folding of the overall composition is not significantly adversely affected, and preferably expression, solubility, and/or folding efficiency are significantly improved. A wide variety of suitable leader sequences have been described in the literature. A non-limiting list of suitable sequences includes maltose binding protein, cellulose binding domain, glutathione S-transferase, 6×His tag (SEQ ID NO: 218), FLAG tag, hemaglutinin tag, and green fluorescent protein. The leader sequence can also be further improved by codon optimization, especially in the second codon position following the ATG start codon, by methods well described in the literature and hereinabove.

Various in vitro enzymatic methods for cleaving proteins at specific sites are known. Such methods include use of enterokinase (DDDK) (SEQ ID NO: 219), Factor Xa (IDGR) (SEQ ID NO: 880), thrombin (LVPRGS) (SEQ ID NO: 220), PreScission™ (LEVLFQGP) (SEQ ID NO: 221), TEV protease (EQLYFQG) (SEQ ID NO: 222), 3C protease (ETLFQGP) (SEQ ID NO: 223), Sortase A (LPETG) (SEQ ID NO: 224), Granzyme B (D/X, N/X, M/N or S/X), inteins, SUMO, DAPase (TAGZyme™), Aeromonas aminopeptidase, Aminopeptidase M, and carboxypeptidases A and B. Additional methods are disclosed in Arnau, et al., Protein Expression and Purification 48: 1-13 (2006).

In other embodiments, an optimized polynucleotide sequence encoding at least about 20 to about 60 amino acids with XTEN characteristics can be included at the N-terminus of the XTEN sequence to promote the initiation of translation to allow for expression of XTEN fusions at the N-terminus of proteins without the presence of a helper domain. In an advantage of the foregoing, the sequence does not require subsequent cleavage, thereby reducing the number of steps to manufacture XTEN-containing compositions. As described in more detail in the Examples, the optimized N-terminal sequence has attributes of an unstructured protein, but may include nucleotide bases encoding amino acids selected for their ability to promote initiation of translation and enhanced expression. In one embodiment of the foregoing, the optimized polynucleotide encodes an XTEN sequence with at least about 90% sequence identity to AE624. In another embodiment of the foregoing, the optimized polynucleotide encodes an XTEN sequence with at least about 90% sequence identity to AE912. In yet another embodiment of the foregoing, the optimized polynucleotide encodes an XTEN sequence with at least about 90% sequence identity to AM923.

In another embodiment, the protease site of the leader sequence construct is chosen such that it is recognized by an in vivo protease. In this embodiment, the protein is purified from the expression system while retaining the leader by avoiding contact with an appropriate protease. The full-length construct is then injected into a patient. Upon injection, the construct comes into contact with the protease specific for the cleavage site and is cleaved by the protease. In the case where the uncleaved protein is substantially less active than the cleaved form, this method has the beneficial effect of allowing higher initial doses while avoiding toxicity, as the active form is generated slowly in vivo. Some non-limiting examples of in vivo proteases which are useful for this application include tissue FXIa, FXIIa, kallikrein, FVIIa, FIXa, FXa, FIIa (thrombin), Elastase-2, granzyme B, MMP-12, MMP-13, MMP-17 or MMP-20, or by non-mammalian proteases such as TEV, enterokinase, PreScission™ protease (rhinovirus 3C protease), and sortase A.

In this manner, a chimeric DNA molecule coding for a monomeric binding fusion protein is generated within the construct. Optionally, this chimeric DNA molecule may be transferred or cloned into another construct that is a more appropriate expression vector. At this point, a host cell capable of expressing the chimeric DNA molecule can be transformed with the chimeric DNA molecule. The vectors containing the DNA segments of interest can be transferred into the host cell by well-known methods, depending on the type of cellular host. For example, calcium chloride transfection is commonly utilized for prokaryotic cells, whereas calcium phosphate treatment, lipofection, or electroporation may be used for other cellular hosts. Other methods used to transform mammalian cells include the use of polybrene, protoplast fusion, liposomes, electroporation, and microinjection. See, generally, Sambrook, et al., supra.

The transformation may occur with or without the utilization of a carrier, such as an expression vector. Then, the transformed host cell is cultured under conditions suitable for expression of the chimeric DNA molecule encoding the binding fusion protein.

The present invention also provides a host cell for expressing the monomeric fusion protein compositions disclosed herein. Examples of suitable eukaryotic host cells include, but are not limited to mammalian cells, such as VERO cells, HELA cells such as ATCC No. CCL2, CHO cell lines, COS cells, WI38 cells, BHK cells, HepG2 cells, 3T3 cells, A549 cells, PC12 cells, K562 cells, 293 cells, Sf9 cells and CvI cells. Examples of suitable non-mammalian eukaryotic cells include eukaryotic microbes such as filamentous fungi or yeast are suitable cloning or expression hosts for encoding vectors. *Saccharomyces cerevisiae* is a commonly used lower eukaryotic host microorganism. Others include *Schizosaccharomyces pombe* (Beach and Nurse, Nature, 290: 140 [1981]; EP 139,383 published 2 May 1985); *Kluyveromyces* hosts (U.S. Pat. No. 4,943,529; Fleer et al., Bio/Technology, 9:968-975 (1991)) such as, e.g., *K. lactis* (MW98-8C, CBS683, CBS4574; Louvencourt et al., J. Bacteriol., 737 [1983]), *K. fragilis* (ATCC 12,424), *K. bulgaricus* (ATCC 16,045), *K. wickeramii* (ATCC 24,178), *K. waltii* (ATCC 56,500), *K. drosophilarum* (ATCC 36,906; Van den Berg et al., Bio/Technology, 8:135 (1990)), *K. thermotolerans*, and *K. marxianus; yarrowia* (EP 402,226); *Pichia pastoris* (EP 183,070; Sreekrishna et al., J. Basic Microbiol., 28:265-278 [1988]); *Candida; Trichoderma reesia* (EP 244,234); *Neurospora crassa* (Case et al., Proc. Natl. Acad. Sci. USA, 76:5259-5263 [1979]); *Schwanniomyces* such as *Schwanniomyces occidentalis* (EP 394,538 published 31 Oct. 1990); and filamentous fungi such as, e.g., *Neurospora, Penicillium, Tolypocladium* (WO 91/00357 published 10 Jan. 1991), and *Aspergillus* hosts such as *A. nidulans* (Ballance et al., Biochem. Biophys. Res. Commun., 112:284-289 [1983]; Tilburn et al., Gene, 26:205-221 [1983]; Yelton et al., Proc. Natl. Acad. Sci. USA, 81: 1470-1474 [1984]) and *A. niger* (Kelly and Hynes, EMBO J., 4:475-479 [1985]). Methylotropic yeasts are suitable herein and include, but are not limited to, yeast capable of growth on methanol selected from the genera consisting of *Hansenula, Candida, Kloeckera, Pichia, Saccharomyces, Torulopsis*, and *Rhodotorula*. A list of specific species that are exemplary of this class of yeasts may be found in C. Anthony, The Biochemistry of Methylotrophs, 269 (1982).

Other suitable cells that can be used in the present invention include, but are not limited to, prokaryotic host cells strains such as *Escherichia coli*, (e.g., strain DH5-α), *Bacillus subtilis, Salmonella typhimurium*, or strains of the genera of *Pseudomonas, Streptomyces* and *Staphylococcus*. Non-limiting examples of suitable prokaryotes include those from the genera: *Actinoplanes; Archaeoglobus; Bdellovibrio; Borrelia; Chloroflexus; Enterococcus; Escherichia; Lactobacillus; Listeria; Oceanobacillus; Paracoccus; Pseudomonas; Staphylococcus; Streptococcus; Streptomyces; Thermoplasma*; and *Vibrio*. Non-limiting examples of specific strains include: *Archaeoglobus fulgidus; Bdellovibrio bacteriovorus; Borrelia burgdorferi; Chloroflexus aurantiacus; Enterococcus faecalis; Enterococcus faecium; Lactobacillus johnsonii; Lactobacillus plantarum; Lactococcus lactis; Listeria innocua; Listeria monocytogenes; Oceanobacillus iheyensis; Paracoccus zeaxanthinifaciens; Pseudomonas mevalonii; Staphylococcus aureus; Staphylococcus epidermidis; Staphylococcus haemolyticus; Streptococcus agalactiae; Streptomyces griseolosporeus; Streptococcus mutans; Streptococcus pneumoniae; Streptococcus pyogenes; Thermoplasma acidophilum; Thermoplasma volcanium; Vibrio cholerae; Vibrio parahaemolyticus*; and *Vibrio vulnificus*.

Host cells containing the polynucleotides of interest can be cultured in conventional nutrient media (e.g., Ham's nutrient mixture) modified as appropriate for activating promoters, selecting transformants or amplifying genes. The culture conditions, such as temperature, pH and the like, are those previously used with the host cell selected for expression, and will be apparent to the ordinarily skilled artisan. Cells are typically harvested by centrifugation, disrupted by physical or chemical means, and the resulting crude extract retained for further purification. For compositions secreted by the host cells, supernatant from centrifugation is separated and retained for further purification. Microbial cells employed in expression of proteins can be disrupted by any convenient method, including freeze-thaw cycling, sonication, mechanical disruption, or use of cell lysing agents, all of which are well known to those skilled in the art. Embodiments that involve cell lysis may entail use of a buffer that contains protease inhibitors that limit degradation after expression of the chimeric DNA molecule. Suitable protease inhibitors include, but are not limited to leupeptin, pepstatin or aprotinin. The supernatant then may be precipitated in successively increasing concentrations of saturated ammonium sulfate.

Gene expression may be measured in a sample directly, for example, by conventional Southern blotting, Northern blotting to quantitate the transcription of mRNA [Thomas, Proc. Natl. Acad. Sci. USA, 77:5201-5205 (1980)], dot blotting (DNA analysis), or in situ hybridization, using an appropriately labeled probe, based on the sequences provided herein. Alternatively, antibodies may be employed that can recognize specific duplexes, including DNA duplexes, RNA duplexes, and DNA-RNA hybrid duplexes or DNA-protein duplexes.

The antibodies in turn may be labeled and the assay may be carried out where the duplex is bound to a surface, so that upon the formation of duplex on the surface, the presence of antibody bound to the duplex can be detected.

Gene expression, alternatively, may be measured by immunological of fluorescent methods, such as immunohistochemical staining of cells or tissue sections and assay of cell culture or body fluids or the detection of selectable markers, to quantitate directly the expression of gene product. Antibodies useful for immunohistochemical staining and/or assay of sample fluids may be either monoclonal or polyclonal, and may be prepared in any mammal. Conveniently, the antibodies may be prepared against a native sequence polypeptide or against a synthetic peptide based on the DNA sequences provided herein or against exogenous sequence fused to targeting moieties and encoding a specific epitope. Examples of selectable markers are well known to one of skill in the art and include reporters such as enhanced green fluorescent protein (EGFP), beta-galactosidase (β-gal) or chloramphenicol acetyltransferase (CAT).

Expressed binding fusion protein product(s) may be purified via methods known in the art or by methods disclosed herein. Procedures such as gel filtration, affinity purification, salt fractionation, ion exchange chromatography, size exclusion chromatography, hydroxyapatite adsorption chromatography, hydrophobic interaction chromatography and gel electrophoresis may be used; each tailored to recover and purify the fusion protein produced by the respective host cells. Some expressed binding fusion protein may require refolding during isolation and purification. Methods of purification are described in Robert K. Scopes, Protein Purification: Principles and Practice, Charles R. Castor (ed.), Springer-Verlag 1994, and Sambrook, et al., supra. Multi-step purification separations are also described in Baron, et al., Crit. Rev. Biotechnol. 10:179-90 (1990) and Below, et al., J. Chromatogr. A. 679:67-83 (1994).

IV). Pharmaceutical Compositions

The present invention provides pharmaceutical compositions comprising binding fusion proteins, XTEN-drug conjugates, or BFP-D conjugates. In one embodiment, the pharmaceutical composition comprises the binding fusion protein and at least one pharmaceutically acceptable carrier. In another embodiment, the pharmaceutical composition comprises the BFP-D and at least one pharmaceutically acceptable carrier. In another embodiment, the pharmaceutical composition comprises the XTEN-drug conjugate and at least one pharmaceutically acceptable carrier. The pharmaceutical compositions of the present invention can be formulated according to known methods to prepare pharmaceutically useful compositions, whereby the polypeptide is combined in admixture with a pharmaceutically acceptable carrier vehicle, such as aqueous solutions or buffers, pharmaceutically acceptable suspensions and emulsions. Examples of non-aqueous solvents include propyl ethylene glycol, polyethylene glycol and vegetable oils. Therapeutic formulations are prepared for storage by mixing the active ingredient having the desired degree of purity with optional physiologically acceptable carriers, excipients or stabilizers, as described in Remington's Pharmaceutical Sciences 16th edition, Osol, A. Ed. (1980), in the form of lyophilized formulations or aqueous solutions. In addition, the pharmaceutical compositions can also contain other pharmaceutically active compounds or a plurality of compositions of the invention.

The pharmaceutical compositions may be administered for therapy by any suitable route including oral, rectal, nasal, topical (including transdermal, aerosol, buccal and sublingual), vaginal, parenteral (including subcutaneous, subcutaneous by infusion pump, intramuscular, intravenous and intradermal), intravitreal, and pulmonary. It will also be appreciated that the preferred route will vary with the condition and age of the recipient, and the disease being treated.

In preferred embodiments, the pharmaceutical composition is administered parenterally. In this embodiment, the composition may be supplied as a lyophilized powder to be reconstituted prior to administration. The composition may also be supplied in a liquid form, which can be administered directly to a patient. In one embodiment, the composition is supplied as a liquid in a pre-filled syringe such that a patient can easily self-administer the composition.

The compositions of the invention may be formulated using a variety of excipients. Suitable excipients include microcrystalline cellulose (e.g. Avicel PH102, Avicel PH101), polymethacrylate, poly(ethyl acrylate, methyl methacrylate, trimethylammonioethyl methacrylate chloride) (such as Eudragit RS-30D), hydroxypropyl methylcellulose (Methocel K100M, Premium CR Methocel K100M, Methocel E5, Opadry®), magnesium stearate, talc, triethyl citrate, aqueous ethylcellulose dispersion (Surelease®), and protamine sulfate. The slow release agent may also comprise a carrier, which can comprise, for example, solvents, dispersion media, coatings, antibacterial and antifungal agents, isotonic and absorption delaying agents. Pharmaceutically acceptable salts can also be used in these slow release agents, for example, mineral salts such as hydrochlorides, hydrobromides, phosphates, or sulfates, as well as the salts of organic acids such as acetates, proprionates, malonates, or benzoates. The composition may also contain liquids, such as water, saline, glycerol, and ethanol, as well as substances such as wetting agents, emulsifying agents, or pH buffering agents. Liposomes may also be used as a carrier.

For liquid formulations, a desired property is that the formulation be supplied in a form that can pass through a 25, 28, 30, 31, 32 gauge needle for intravenous, intramuscular, intraarticular, or subcutaneous administration. Syringe pumps may also be used to delivery the pharmaceutical compositions of the invention. Such devices are described in U.S. Pat. Nos. 4,976,696; 4,933,185; 5,017,378; 6,309,370; 6,254,573; 4,435,173; 4,398,908; 6,572,585; 5,298,022; 5,176,502; 5,492,534; 5,318,540; and 4,988,337, the contents of which are incorporated herein by reference. One skilled in the art, considering both the disclosure of this invention and the disclosures of these other patents could produce a syringe pump for the extended release of the compositions of the present invention.

Administration via transdermal formulations can be performed using methods also known in the art, including those described generally in, e.g., U.S. Pat. Nos. 5,186,938 and 6,183,770, 4,861,800, 6,743,211, 6,945,952, 4,284,444, and WO 89/09051, incorporated herein by reference in their entireties. A transdermal patch is a particularly useful embodiment with polypeptides having absorption problems. Patches can be made to control the release of skin-permeable active ingredients over a 12 hour, 24 hour, 3 day, and 7 day period. In one example, a 2-fold daily excess of a polypeptide of the present invention is placed in a non-volatile fluid. The compositions of the invention are provided in the form of a viscous, non-volatile liquid. The penetration through skin of specific formulations may be measures by standard methods in the art (for example, Franz et al., J. Invest. Derm. 64:194-195 (1975)). Examples of suitable patches are passive transfer skin patches, iontophoretic skin patches, or patches with microneedles such as Nicoderm.

In other embodiments, the composition may be delivered via intranasal, buccal, or sublingual routes to the brain to enable transfer of the active agents through the olfactory passages into the CNS and reducing the systemic administration. Devices commonly used for this route of administration are included in U.S. Pat. No. 6,715,485. Compositions delivered via this route may enable increased CNS dosing or reduced total body burden reducing systemic toxicity risks associated with certain drugs. Preparation of a pharmaceutical composition for delivery in a subdermally implantable device can be performed using methods known in the art, such as those described in, e.g., U.S. Pat. Nos. 3,992,518; 5,660,848; and 5,756,115.

V). Pharmaceutical Kits

In another aspect, the invention provides a kit to facilitate the use of the composition embodiments disclosed herein. In one embodiment, the kit comprises, in at least a first container: (a) an amount of a binding fusion protein composition sufficient to administer in treatment of a subject with a disease, condition or disorder; and (b) an amount of a pharmaceutically acceptable carrier; together in a formulation ready for injection or for reconstitution with sterile water, buffer, or dextrose; together with a label identifying the binding fusion protein drug and storage and handling conditions, and/or a sheet of the approved indications for the drug and instructions for the reconstitution and/or administration of the binding fusion protein drug for the use for the prevention and/or treatment of a approved indication, appropriate dosage and safety information, and information identifying the lot and expiration of the drug.

In another embodiment, the kit comprises, in at least a first container: (a) an amount of a binding fusion protein-drug conjugate composition sufficient to administer in treatment of a subject with a disease, condition or disorder; and (b) an amount of a pharmaceutically acceptable carrier; together in a formulation ready for injection or for reconstitution with sterile water, buffer, or dextrose; together with a label identifying the binding fusion protein-drug conjugate and storage and handling conditions, and/or a sheet of the approved indications for the drug and instructions for the reconstitution and/or administration of the compositions for the use for the prevention and/or treatment of a approved indication, appropriate dosage and safety information, and information identifying the lot and expiration of the drug.

In another embodiment, the kit comprises, in at least a first container: (a) an amount of an XTEN-drug conjugate composition sufficient to administer in treatment of a subject with a disease, condition or disorder; and (b) an amount of a pharmaceutically acceptable carrier; together in a formulation ready for injection or for reconstitution with sterile water, buffer, or dextrose; together with a label identifying the XTEN-drug conjugate and storage and handling conditions, and/or a sheet of the approved indications for the drug and instructions for the reconstitution and/or administration of the compositions for the use for the prevention and/or treatment of a approved indication, appropriate dosage and safety information, and information identifying the lot and expiration of the drug.

In any of the embodiments of the foregoing kits, the kit can comprise a second container that can carry a suitable diluent for the subject composition, which will provide the user with the appropriate concentration of the pharmaceutical composition to be delivered to the subject.

EXAMPLES

Example 1

Construction of XTEN_AD36 Motif Segments

The following example describes the construction of a collection of codon-optimized genes encoding motif sequences of 36 amino acids. As a first step, a stuffer vector pCW0359 was constructed based on a pET vector and that includes a T7 promoter. pCW0359 encodes a cellulose binding domain (CBD) and a TEV protease recognition site followed by a stuffer sequence that is flanked by BsaI, BbsI, and KpnI sites. The BsaI and BbsI sites were inserted such that they generate compatible overhangs after digestion. The stuffer sequence is followed by a truncated version of the GFP gene and a His tag. The stuffer sequence contains stop codons and thus E. coli cells carrying the stuffer plasmid pCW0359 form non-fluorescent colonies. The stuffer vector pCW0359 was digested with BsaI and KpnI to remove the stuffer segment and the resulting vector fragment was isolated by agarose gel purification. The sequences were designated XTEN_AD36, reflecting the AD family of motifs. Its segments have the amino acid sequence [X]$_3$ where X is a 12mer peptide with the sequences: GESPGGSSGSES (SEQ ID NO: 2), GSEGSSGPGESS (SEQ ID NO: 3), GSSESGSSEGGP (SEQ ID NO: 4), or GSGGEPSESGSS (SEQ ID NO: 5). The insert was obtained by annealing the following pairs of phosphorylated synthetic oligonucleotide pairs:

```
AD1for:
                              (SEQ ID NO: 225)
AGGTGAATCTCCDGGTGGYTCYAGCGGTTCYGARTC AD1rev:
                              (SEQ ID NO: 226)
ACCTGAYTCRGAACCGCTRGARCCACCHGGAGATTC AD2for:
                              (SEQ ID NO: 227)
AGGTAGCGAAGGTTCTTCYGGTCCDGGYGARTCYTC AD2rev:
                              (SEQ ID NO: 228)
ACCTGARGAYTCRCCHGGACCRGAAGAACCTTCGCT AD3for:
                              (SEQ ID NO: 229)
AGGTTCYTCYGAAAGCGGTTCTTCYGARGGYGGTCC AD3rev:
                              (SEQ ID NO: 230)
ACCTGGACCRCCYTCRGAAGAACCGCTTTCRGARGA AD4for:
                              (SEQ ID NO: 231)
AGGTTCYGGTGGYGAACCDTCYGARTCTGGTAGCTC
```

We also annealed the phosphorylated oligonucleotide 3 KpnIstopperFor: AGGTTCGTCTTCACTCGAGGGTAC (SEQ ID NO: 232) and the non-phosphorylated oligonucleotide pr_3KpnIstopperRev: CCTCGAGTGAAGACGA (SEQ ID NO: 233). The annealed oligonucleotide pairs were ligated, which resulted in a mixture of products with varying length that represents the varying number of 12mer repeats ligated to one BbsI/KpnI segment. The products corresponding to the length of 36 amino acids were isolated from the mixture by preparative agarose gel electrophoresis and ligated into the BsaI/KpnI digested stuffer vector pCW0359. Most of the clones in the resulting library designated LCW0401 showed green fluorescence after induction, which shows that the sequence of XTEN_AD36 had been ligated in frame with the GFP gene and that most sequences of XTEN_AD36 had good expression levels.

We screened 96 isolates from library LCW0401 for high level of fluorescence by stamping them onto agar plate containing IPTG. The same isolates were evaluated by PCR and 48 isolates were identified that contained segments with 36 amino acids as well as strong fluorescence. These isolates were sequenced and 39 clones were identified that contained correct XTEN_AD36 segments. The file names of the nucleotide and amino acid constructs and the sequences for these segments are listed in Table 11.

TABLE 11

DNA and Amino Acid Sequences for 36-mer motifs

| File name | Amino acid sequence | SEQ ID NO: | Nucleotide sequence | SEQ ID NO: |
|---|---|---|---|---|
| LCW0401_001_GFP-N_A01.ab1 | GSGGEPSESGSSGESP GGSSGSESGESPGGSS GSES | 234 | GGTTCTGGTGGCGAACCGTCCGAGTCTGGTAG CTCAGGTGAATCTCCGGGTGGCTCTAGCGGTT CCGAGTCAGGTGAATCTCCTGGTGGTTCCAGC GGTTCCGAGTCA | 272 |
| LCW0401_002_GFP-N_B01.ab1 | GSEGSSGPGESSGESP GGSSGSESGSSESGSS EGGP | 235 | GGTAGCGAAGGTTCTTCTGGTCCTGGCGAGTC TTCAGGTGAATCTCCTGGTGGTTCCAGCGGTTC TGAATCAGGTTCCTCCGAAAGCGGTTCTTCCG AGGGCGGTCCA | 273 |
| LCW0401_003_GFP-N_C01.ab1 | GSSESGSSEGGPGSSE SGSSEGGPGESPGGSS GSES | 236 | GGTTCCTCTGAAAGCGGTTCTTCCGAAGGTGG TCCAGGTTCCTCTGAAAGCGGTTCTTCTGAGGG TGGTCCAGGTGAATCTCCGGGTGGCTCCAGCG GTTCCGAGTCA | 274 |
| LCW0401_004_GFP-N_D01.ab1 | GSGGEPSESGSSGSSE SGSSEGGPGSGGEPSE SGSS | 237 | GGTTCCGGTGGCGAACCGTCTGAATCTGGTAG CTCAGGTTCTTCTGAAAGCGGTTCTTCCGAGGG TGGTCCAGGTTCTGGTGGTGAACCTTCCGAGTC TGGTAGCTCA | 275 |
| LCW0401_007_GFP-N_F01.ab1 | GSSESGSSEGGPGSEG SSGPGESSGSEGSSGP GESS | 238 | GGTTCTTCCGAAAGCGGTTCTTCTGAGGGTGGT CCAGGTAGCGAAGGTTCTTCCGGTCCAGGTGA GTCTTCAGGTAGCGAAGGTTCTTCTGGTCCTGG TGAATCTTCA | 276 |
| LCW0401_008_GFP-N_G01.ab1 | GSSESGSSEGGPGESP GGSSGSESGSSESGSS | 239 | GGTTCCTCTGAAAGCGGTTCTTCCGAGGGTGG TCCAGGTGAATCTCCAGGTGGTTCCAGCGGTT CTGAGTCAGGTAGCGAAGGTTCTTCTGGTCCA GGTGAATCCTCA | 277 |
| LCW0401_012_GFP-N_H01.ab1 | GSGGEPSESGSSGSGG EPSESGSSGSEGSSGP GESS | 240 | GGTTCTGGTGGTGAACCGTCTGAGTCTGGTAG CTCAGGTTCCGGTGGCGAACCATCCGAATCTG GTAGCTCAGGTAGCGAAGGTTCTTCCGGTCCA GGTGAGTCTTCA | 278 |
| LCW0401_015_GFP-N_A02.ab1 | GSSESGSSEGGPGSEG SSGPGESSGESPGGSS GSES | 241 | GGTTCTTCCGAAAGCGGTTCTTCTGAAGGCGG TCCAGGTAGCGAAGGTTCTTCTGGTCCAGGCG AATCTTCAGGTGAATCTCCTGGTGGCTCCAGC GGTTCTGAGTCA | 279 |
| LCW0401_016_GFP-N_B02.ab1 | GSSESGSSEGGPGSSE SGSSEGGPGSSESGSS EGGP | 242 | GGTTCCTCCGAAAGCGGTTCTTCTGAGGGCGG TCCAGGTTCCTCCGAAAGCGGTTCTTCCGAGG GCGGTCCAGGTTCTTCTGAAAGCGGTTCTTCCG AGGGCGGTCCA | 280 |
| LCW0401_020_GFP-N_E02.ab1 | GSGGEPSESGSSSGEG SSGPGESSGSSESGSS EGGP | 243 | GGTTCCGGTGGCGAACCGTCCGAATCTGGTAG CTCAGGTAGCGAAGGTTCTTCTGGTCCAGGCG AATCTTCAGGTTCCTCTGAAAGCGGTTCTTCTG AGGGCGGTCCA | 281 |
| LCW0401_022_GFP-N_F02.ab1 | GSGGEPSESGSSSGSSE SGSSEGGPGSGGEPSE SGSS | 244 | GGTTCTGGTGGTGAACCGTCCGAATCTGGTAG CTCAGGTTCTTCCGAAAGCGGTTCTTCTGAAGG TGGTCCAGGTTCCGGTGGCGAACCTTCTGAAT CTGGTAGCTCA | 282 |
| LCW0401_024_GFP-N_G02.ab1 | GSGGEPSESGSSGSSE SGSSEGGPGESPGGSS GSES | 245 | GGTTCTGGTGGCGAACCGTCCGAATCTGGTAG CTCAGGTTCCTCCGAAAGCGGTTCTTCTGAAG GTGGTCCAGGTGAATCTCCAGGTGGTTCTAGC GGTTCTGAATCA | 283 |
| LCW0401_026_GFP-N_H02.ab1 | GSGGEPSESGSSGESP GGSSGSESGSEGSSGP GESS | 246 | GGTTCTGGTGGCGAACCGTCTGAGTCTGGTAG CTCAGGTGAATCTCCTGGTGGCTCCAGCGGTTC TGAATCAGGTAGCGAAGGTTCTTCTGGTCCTG GTGAATCTTCA | 284 |
| LCW0401_027_GFP-N_A03.ab1 | GSGGEPSESGSSGESP GGSSGSESGSGGEPSE SGSS | 247 | GGTTCCGGTGGCGAACCTTCCGAATCTGGTAG CTCAGGTGAATCTCCGGGTGGTTCTAGCGGTTC TGAGTCAGGTTCTGGTGGTGAACCTTCCGAGT CTGGTAGCTCA | 285 |

TABLE 11-continued

DNA and Amino Acid Sequences for 36-mer motifs

| File name | Amino acid sequence | SEQ ID NO: | Nucleotide sequence | SEQ ID NO: |
|---|---|---|---|---|
| LCW0401_028_GFP-N_B03.ab1 | GSSESGSSEGGPGSSE SGSSEGGPGSSESGSS EGGP | 248 | GGTTCCTCTGAAAGCGGTTCTTCTGAGGGCGG TCCAGGTTCTTCCGAAAGCGGTTCTTCCGAGG GCGGTCCAGGTTCTTCCGAAAGCGGTTCTTCTG AAGGCGGTCCA | 286 |
| LCW0401_030_GFP-N_C03.ab1 | GESPGGSSGSESGSEG SSGPGESSGSEGSSGP GESS | 249 | GGTGAATCTCCGGGTGGCTCCAGCGGTTCTGA GTCAGGTAGCGAAGGTTCTTCCGGTCCGGGTG AGTCCTCAGGTAGCGAAGGTTCTTCCGGTCCT GGTGAGTCTTCA | 287 |
| LCW0401_031_GFP-N_D03.ab1 | GSGGEPSESGSSGSGG EPSESGSSGSSESGSS EGGP | 250 | GGTTCTGGTGGCGAACCTTCCGAATCTGGTAG CTCAGGTTCCGGTGGTGAACCTTCTGAATCTGG TAGCTCAGGTTCTTCTGAAAGCGGTTCTTCCGA GGGCGGTCCA | 288 |
| LCW0401_033_GFP-N_E03.ab1 | GSGGEPSESGSSGSGG EPSESGSSGSGGEPSE SGSS | 251 | GGTTCCGGTGGTGAACCTTCTGAATCTGGTAG CTCAGGTTCCGGTGGCGAACCATCCGAGTCTG GTAGCTCAGGTTCCGGTGGTGAACCATCCGAG TCTGGTAGCTCA | 289 |
| LCW0401_037_GFP-N_F03.ab1 | GSGGEPSESGSSGSSE SGSSEGGPGSEGSSGP GESS | 252 | GGTTCCGGTGGCGAACCTTCTGAATCTGGTAG CTCAGGTTCCTCCGAAAGCGGTTCTTCTGAGG GCGGTCCAGGTAGCGAAGGTTCTTCTGGTCCG GGCGAGTCTTCA | 290 |
| LCW0401_038_GFP-N_G03.ab1 | GSGGEPSESGSSGSEG SSGPGESSGSGGEPSE SGSS | 253 | GGTTCCGGTGGTGAACCGTCCGAGTCTGGTAG CTCAGGTAGCGAAGGTTCTTCTGGTCCGGGTG AGTCTTCAGGTTCTGGTGGCGAACCGTCCGAA TCTGGTAGCTCA | 291 |
| LCW0401_039_GFP-N_H03.ab1 | GSGGEPSESGSSGESP GGSSGSESGSGGEPSE SGSS | 254 | GGTTCTGGTGGCGAACCGTCCGAATCTGGTAG CTCAGGTGAATCTCCTGGTGGTTCCAGCGGTTC CGAGTCAGGTTCTGGTGGCGAACCTTCCGAAT CTGGTAGCTCA | 292 |
| LCW0401_040_GFP-N_A04.ab1 | GSSESGSSEGGPGSGG EPSESGSSGSSESGSS EGGP | 255 | GGTTCTTCCGAAAGCGGTTCTTCCGAGGGCGG TCCAGGTTCCGGTGGTGAACCATCTGAATCTG GTAGCTCAGGTTCTTCTGAAAGCGGTTCTTCTG AAGGTGGTCCA | 293 |
| LCW0401_042_GFP-N_C04.ab1 | GSEGSSGPGESSGESP GGSSGSESGSEGSSGP GESS | 256 | GGTAGCGAAGGTTCTTCCGGTCCTGGTGAGTC TTCAGGTGAATCTCCAGGTGGCTCTAGCGGTTC CGAGTCAGGTAGCGAAGGTTCTTCTGGTCCTG GCGAGTCCTCA | 294 |
| LCW0401_046_GFP-N_D04.ab1 | GSSESGSSEGGPGSSE SGSSEGGPGSSESGSS EGGP | 257 | GGTTCCTCTGAAAGCGGTTCTTCCGAAGGCGG TCCAGGTTCTTCCGAAAGCGGTTCTTCTGAGGG CGGTCCAGGTTCCTCCGAAAGCGGTTCTTCTGA GGGTGGTCCA | 295 |
| LCW0401_047_GFP-N_E04.ab1 | GSGGEPSESGSSGESP GGSSGSESGESPGGSS GSES | 258 | GGTTCTGGTGGCGAACCTTCCGAGTCTGGTAG CTCAGGTGAATCTCCGGGTGGTTCTAGCGGTTC CGAGTCAGGTGAATCTCCGGGTGGTTCCAGCG GTTCTGAGTCA | 296 |
| LCW0401_051_GFP-N_F04.ab1 | GSGGEPSESGSSGSEG SSGPGESSGESPGGSS GSES | 259 | GGTTCTGGTGGCGAACCATCTGAGTCTGGTAG CTCAGGTAGCGAAGGTTCTTCCGGTCCAGGCG AGTCTTCAGGTGAATCTCCTGGTGGCTCCAGC GGTTCTGAGTCA | 297 |
| LCW0401_053_GFP-N_H04.ab1 | GESPGGSSGSESGESP GGSSGSESGESPGGSS GSES | 260 | GGTGAATCTCCTGGTGGTTCCAGCGGTTCCGA GTCAGGTGAATCTCCAGGTGGCTCTAGCGGTT CCGAGTCAGGTGAATCTCCTGGTGGTTCTAGC GGTTCTGAATCA | 298 |
| LCW0401_054_GFP-N_A05.ab1 | GSEGSSGPGESSGSEG SSGPGESSGSGGEPSE SGSS | 261 | GGTAGCGAAGGTTCTTCCGGTCCAGGTGAATC TTCAGGTAGCGAAGGTTCTTCTGGTCCTGGTGA ATCCTCAGGTTCCGGTGGCGAACCATCTGAAT CTGGTAGCTCA | 299 |
| LCW0401_059_GFP-N_D05.ab1 | GSGGEPSESGSSGSEG SSGPGESSGESPGGSS GSES | 262 | GGTTCTGGTGGCGAACCATCCGAATCTGGTAG CTCAGGTAGCGAAGGTTCTTCTGGTCCTGGCG AATCTTCAGGTGAATCTCCAGGTGGCTCTAGC GGTTCCGAATCA | 300 |

TABLE 11-continued

DNA and Amino Acid Sequences for 36-mer motifs

| File name | Amino acid sequence | SEQ ID NO: | Nucleotide sequence | SEQ ID NO: |
|---|---|---|---|---|
| LCW0401_060_GFP-N_E05.ab1 | GSGGEPSESGSSGSSE SGSSEGGPGSGGEPSE SGSS | 263 | GGTTCCGGTGGTGAACCGTCCGAATCTGGTAG CTCAGGTTCCTCTGAAAGCGGTTCTTCCGAGG GTGGTCCAGGTTCCGGTGGTGAACCTTCTGAG TCTGGTAGCTCA | 301 |
| LCW0401_061_GFP-N_F05.ab1 | GSSESGSSEGGPGSGG EPSESGSSGSEGSSGP GESS | 264 | GGTTCCTCTGAAAGCGGTTCTTCTGAGGGCGG TCCAGGTTCTGGTGGCGAACCATCTGAATCTG GTAGCTCAGGTAGCGAAGGTTCTTCCGGTCCG GGTGAATCTTCA | 302 |
| LCW0401_063_GFP-N_H05.ab1 | GSGGEPSESGSSGSEG SSGPGESSGSEGSSGP GESS | 265 | GGTTCTGGTGGTGAACCGTCCGAATCTGGTAG CTCAGGTAGCGAAGGTTCTTCTGGTCCTGGCG AGTCTTCAGGTAGCGAAGGTTCTTCTGGTCCTG GTGAATCTTCA | 303 |
| LCW0401_066_GFP-N_B06.ab1 | GSGGEPSESGSSGSSE SGSSEGGPGSGGEPSE SGSS | 266 | GGTTCTGGTGGCGAACCATCCGAGTCTGGTAG CTCAGGTTCTTCCGAAAGCGGTTCTTCCGAAG GCGGTCCAGGTTCTGGTGGTGAACCGTCCGAA TCTGGTAGCTCA | 304 |
| LCW0401_067_GFP-N_C06.ab1 | GSGGEPSESGSSGESP GGSSGSESGESPGGSS GSES | 267 | GGTTCCGGTGGCGAACCTTCCGAATCTGGTAG CTCAGGTGAATCTCCGGGTGGTTCTAGCGGTTC CGAATCAGGTGAATCTCCAGGTGGTTCTAGCG GTTCCGAATCA | 305 |
| LCW0401_069_GFP-N_D06.ab1 | GSGGEPSESGSSGSEG EPSESGSSGESPGGSS GSES | 268 | GGTTCCGGTGGTGAACCATCTGAGTCTGGTAG CTCAGGTTCCGGTGGCGAACCGTCCGAGTCTG GTAGCTCAGGTGAATCTCCGGGTGGTTCCAGC GGTTCCGAATCA | 306 |
| LCW0401_070_GFP-N_E06.ab1 | GSEGSSGPGESSGSSE SGSSEGGPGSEGSSGP GESS | 269 | GGTAGCGAAGGTTCTTCTGGTCCGGGCGAATC CTCAGGTTCCTCCGAAAGCGGTTCTTCCGAAG GTGGTCCAGGTAGCGAAGGTTCTTCCGGTCCT GGTGAATCTTCA | 307 |
| LCW0401_078_GFP-N_F06.ab1 | GSSESGSSEGGPGESP GGSSGSESGESPGGSS GSES | 270 | GGTTCCTCTGAAAGCGGTTCTTCTGAAGGCGG TCCAGGTGAATCTCCGGGTGGCTCCAGCGGTT CTGAATCAGGTGAATCTCCTGGTGGCTCCAGC GGTTCCGAGTCA | 308 |
| LCW0401_079_GFP-N_G06.ab1 | GSEGSSGPGESSGSEG SSGPGESSGSGGEPSE SGSS | 271 | GGTAGCGAAGGTTCTTCTGGTCCAGGCGAGTC TTCAGGTAGCGAAGGTTCTTCCGGTCCTGGCG AGTCTTCAGGTTCCGGTGGCGAACCGTCCGAA TCTGGTAGCTCA | 309 |

Example 2

Construction of XTEN_AE36 Segments

A codon library encoding XTEN sequences of 36 amino acid length was constructed. The XTEN sequence was designated XTEN_AE36. Its segments have the amino acid sequence [X]$_3$ where X is a 12mer peptide with the sequence: GSPAGSPTSTEE (SEQ ID NO: 6), GSEPATSGSETP (SEQ ID NO: 7), GTSESATPESGP (SEQ ID NO: 8), or GTSTEPSEGSAP (SEQ ID NO: 9). The insert was obtained by annealing the following pairs of phosphorylated synthetic oligonucleotide pairs:

```
AE1for:
                              (SEQ ID NO: 310)
AGGTAGCCCDGCWGGYTCTCCDACYTCYACYGARGA AE1rev:
                              (SEQ ID NO: 311)
ACCTTCYTCRGTRGARGTHGGAGARCCWGCHGGGCT AE2for:
                              (SEQ ID NO: 312)
AGGTAGCGAACCKGCWACYTCYGGYTCTGARACYCC AE2rev:
                              (SEQ ID NO: 313)
ACCTGGRGTYTCAGARCCRGARGTWGCMGGTTCGCT AE3for:
                              (SEQ ID NO: 314)
AGGTACYTCTGAAAGCGCWACYCCKGARTCYGGYCC AE3rev:
                              (SEQ ID NO: 315)
ACCTGGRCCRGAYTCMGGRGTWGCGCTTTCAGARGT AE4for:
                              (SEQ ID NO: 316)
AGGTACYTCTACYGAACCKTCYGARGGYAGCGCWCC AE4rev:
                              (SEQ ID NO: 317)
ACCTGGWGCGCTRCCYTCRGAMGGTTCRGTAGARGT
```

We also annealed the phosphorylated oligonucleotide 3 KpnIstopperFor: AGGTTCGTCTTCACTCGAGGGTAC (SEQ ID NO: 232) and the non-phosphorylated oligonucleotide pr_3KpnIstopperRev: CCTCGAGTGAAGACGA (SEQ ID NO: 233). The annealed oligonucleotide pairs were ligated, which resulted in a mixture of products with varying length that represents the varying number of 12mer repeats ligated to one BbsI/KpnI segment. The products corresponding to the length of 36 amino acids were isolated from the mixture by preparative agarose gel electrophoresis and ligated into the BsaI/KpnI digested stuffer vector pCW0359. Most of the clones in the resulting library designated LCW0402 showed green fluorescence after induction which shows that the sequence of XTEN_AE36 had been ligated in frame with the GFP gene and most sequences of XTEN_AE36 show good expression.

We screened 96 isolates from library LCW0402 for high level of fluorescence by stamping them onto agar plate containing IPTG. The same isolates were evaluated by PCR and 48 isolates were identified that contained segments with 36 amino acids as well as strong fluorescence. These isolates were sequenced and 37 clones were identified that contained correct XTEN_AE36 segments. The file names of the nucleotide and amino acid constructs and the sequences for these segments are listed in Table 12.

TABLE 12

DNA and Amino Acid Sequences for 36-mer motifs

| File name | Amino acid sequence | SEQ ID NO: | Nucleotide sequence | SEQ ID NO: |
|---|---|---|---|---|
| LCW0402_002_GFP-N_A07.ab1 | GSPAGSPTSTEEGT SESATPESGPGTSTE PSEGSAP | 318 | GGTAGCCCGGCAGGCTCTCCGACCTCTACTGA GGAAGGTACTTCTGAAAGCGCAACCCCGGAGT CCGGCCCAGGTACCTCTACCGAACCGTCTGAG GGCAGCGCACCA | 355 |
| LCW0402_003_GFP-N_B07.ab1 | GTSTEPSEGSAPGT STEPSEGSAPGTSTE PSEGSAP | 319 | GGTACTTCTACCGAACCGTCCGAAGGCAGCGC TCCAGGTACCTCTACTGAACCTTCCGAGGGCA GCGCTCCAGGTACCTCTACCGAACCTTCTGAA GGTAGCGCACCA | 356 |
| LCW0402_004_GFP-N_C07.ab1 | GTSTEPSEGSAPGT SESATPESGPGTSES ATPESGP | 320 | GGTACCTCTACCGAACCGTCTGAAGGTAGCGC ACCAGGTACCTCTGAAAGCGCAACTCCTGAGT CCGGTCCAGGTACTTCTGAAAGCGCAACCCCG GAGTCTGGCCCA | 357 |
| LCW0402_005_GFP-N_D07.ab1 | GTSTEPSEGSAPGT SESATPESGPGTSES ATPESGP | 321 | GGTACTTCTACTGAACCGTCTGAAGGTAGCGC ACCAGGTACTTCTGAAAGCGCAACCCCGGAAT CCGGCCCAGGTACCTCTGAAAGCGCAACCCCG GAGTCCGGCCCA | 358 |
| LCW0402_006_GFP-N_E07.ab1 | GSEPATSGSETPGT SESATPESGPGSPA GSPTSTEE | 322 | GGTAGCGAACCGGCAACCTCCGGCTCTGAAAC CCCAGGTACCTCTGAAAGCGCTACTCCTGAAT CCGGCCCAGGTAGCCCGGCAGGTTCTCCGACT TCCACTGAGGAA | 359 |
| LCW0402_008_GFP-N_F07.ab1 | GTSESATPESGPGS EPATSGSETPGTSTE PSEGSAP | 323 | GGTACTTCTGAAAGCGCAACCCCTGAATCCGG TCCAGGTAGCGAACCGGCTACTTCTGGCTCTG AGACTCCAGGTACTTCTACCGAACCGTCCGAA GGTAGCGCACCA | 360 |
| LCW0402_009_GFP-N_G07.ab1 | GSPAGSPTSTEEGSP AGSPTSTEEGSEPA TSGSETP | 324 | GGTAGCCCGGCTGGCTCTCCAACCTCCACTGA GGAAGGTAGCCCGGCTGGCTCTCCAACCTCCA CTGAAGAAGGTAGCGAACCGGCTACCTCCGGC TCTGAAACTCCA | 361 |
| LCW0402_011_GFP-N_A08.ab1 | GSPAGSPTSTEEGT SESATPESGPGTSTE PSEGSAP | 325 | GGTAGCCCGGCTGGCTCTCCTACCTCTACTGAG GAAGGTACTTCTGAAAGCGCTACTCCTGAGTC TGGTCCAGGTACCTCTACTGAACCGTCCGAAG GTAGCGCTCCA | 362 |
| LCW0402_012_GFP-N_B08.ab1 | GSPAGSPTSTEEGSP AGSPTSTEEGTSTEP SEGSAP | 326 | GGTAGCCCTGCTGGCTCTCCGACTTCTACTGAG GAAGGTAGCCCGGCTGGTTCTCCGACTTCTACT GAGGAAGGTACTTCTACCGAACCTTCCGAAGG TAGCGCTCCA | 363 |
| LCW0402_013_GFP-N_C08.ab1 | GTSESATPESGPGT STEPSEGSAPGTSTE PSEGSAP | 327 | GGTACTTCTGAAAGCGCTACTCCGGAGTCCGG TCCAGGTACCTCTACCGAACCGTCCGAAGGCA GCGCTCCAGGTACTTCTACTGAACCTTCTGAGG GTAGCGCTCCA | 364 |
| LCW0402_014_GFP-N_D08.ab1 | GTSTEPSEGSAPGSP AGSPTSTEEGTSTEP SEGSAP | 328 | GGTACCTCTACCGAACCTTCCGAAGGTAGCGC TCCAGGTAGCCCGGCAGGTTCTCCTACTTCCAC TGAGGAAGGTACTTCTACCGAACCTTCTGAGG GTAGCGCACCA | 365 |
| LCW0402_015_GFP-N_E08.ab1 | GSEPATSGSETPGSP AGSPTSTEEGTSES | 329 | GGTAGCGAACCGGCTACTTCCGGCTCTGAGAC TCCAGGTAGCCCTGCTGGCTCTCCGACCTCTAC | 366 |

TABLE 12-continued

DNA and Amino Acid Sequences for 36-mer motifs

| File name | Amino acid sequence | SEQ ID NO: | Nucleotide sequence | SEQ ID NO: |
|---|---|---|---|---|
| | ATPESGP | | CGAAGAAGGTACCTCTGAAAGCGCTACCCCTG AGTCTGGCCCA | |
| LCW0402_016_GFP-N_F08.ab1 | GTSTEPSEGSAPGT SESATPESGPGTSES ATPESGP | 330 | GGTACTTCTACCGAACCTTCCGAGGGCAGCGC ACCAGGTACTTCTGAAAGCGCTACCCCTGAGT CCGGCCCAGGTACTTCTGAAAGCGCTACTCCT GAATCCGGTCCA | 367 |
| LCW0402_020_GFP-N_G08.ab1 | GTSTEPSEGSAPGS EPATSGSETPGSPA GSPTSTEE | 331 | GGTACTTCTACTGAACCGTCTGAAGGCAGCGC ACCAGGTAGCGAACCGGCTACTTCCGGTTCTG AAACCCCAGGTAGCCCAGCAGGTTCTCCAACT TCTACTGAAGAA | 368 |
| LCW0402_023_GFP-N_A09.ab1 | GSPAGSPTSTEEGT SESATPESGPGSEPA TSGSETP | 332 | GGTAGCCCTGCTGGCTCTCCAACCTCCACCGA AGAAGGTACCTCTGAAAGCGCAACCCCTGAAT CCGGCCCAGGTAGCGAACCGGCAACCTCCGGT TCTGAAACCCCA | 369 |
| LCW0402_024_GFP-N_B09.ab1 | GTSESATPESGPGSP AGSPTSTEEGSPAG SPTSTEE | 333 | GGTACTTCTGAAAGCGCTACTCCTGAGTCCGG CCCAGGTAGCCCGGCTGGCTCTCCGACTTCCA CCGAGGAAGGTAGCCCCGGCTGGCTCTCCAACT TCTACTGAAGAA | 370 |
| LCW0402_025_GFP-N_C09.ab1 | GTSTEPSEGSAPGT SESATPESGPGTSTE PSEGSAP | 334 | GGTACCTCTACTGAACCTTCTGAGGGCAGCGC TCCAGGTACTTCTGAAAGCGCTACCCCGGAGT CCGGTCCAGGTACTTCTACTGAACCGTCCGAA GGTAGCGCACCA | 371 |
| LCW0402_026_GFP-N_D09.ab1 | GSPAGSPTSTEEGT STEPSEGSAPGSEPA TSGSETP | 335 | GGTAGCCCCGGCAGGCTCTCCGACTTCCACCGA GGAAGGTACCTCTACTGAACCTTCTGAGGGTA GCGCTCCAGGTAGCGAACCGGCAACCTCTGGC TCTGAAACCCCA | 372 |
| LCW0402_027_GFP-N_E09.ab1 | GSPAGSPTSTEEGT STEPSEGSAPGTSTE PSEGSAP | 336 | GGTAGCCCAGCAGGCTCTCCGACTTCCACTGA GGAAGGTACTTCTACTGAACCTTCCGAAGGCA GCGCACCAGGTACCTCTACTGAACCTTCTGAG GGCAGCGCTCCA | 373 |
| LCW0402_032_GFP-N_H09.ab1 | GSEPATSGSETPGT SESATPESGPGSPA GSPTSTEE | 337 | GGTAGCGAACCTGCTACCTCCGGTTCTGAAAC CCCAGGTACTTCTGAAAGCGCAACTCCGGAGT CTGGTCCAGGTAGCCCTGCAGGTTCTCCTACCT CCACTGAGGAA | 374 |
| LCW0402_034_GFP-N_A10.ab1 | GTSESATPESGPGT STEPSEGSAPGTSTE PSEGSAP | 338 | GGTACCTCTGAAAGCGCTACTCCGGAGTCTGG CCCAGGTACCTCTACTGAACCGTCTGAGGGTA GCGCTCCAGGTACTTCTACTGAACCGTCCGAA GGTAGCGCACCA | 375 |
| LCW0402_036_GFP-N_C10.ab1 | GSPAGSPTSTEEGT STEPSEGSAPGTSTE PSEGSAP | 339 | GGTAGCCCGGCTGGTTCTCCGACTTCCACCGA GGAAGGTACCTCTACTGAACCTTCTGAGGGTA GCGCTCCAGGTACCTCTACTGAACCTTCCGAA GGCAGCGCTCCA | 376 |
| LCW0402_039_GFP-N_E10.ab1 | GTSTEPSEGSAPGT STEPSEGSAPGTSTE PSEGSAP | 340 | GGTACTTCTACCGAACCGTCCGAGGGCAGCGC TCCAGGTACTTCTACTGAACCTTCGAAGGCA GCGCTCCAGGTACTTCTACTGAACCTTCCGAA GGTAGCGCACCA | 377 |
| LCW0402_040_GFP-N_F10.ab1 | GSEPATSGSETPGT SESATPESGPGTSTE PSEGSAP | 341 | GGTAGCGAACCTGCAACCTCTGGCTCTGAAAC CCCAGGTACCTCTGAAAGCGCTACTCCTGAAT CTGGCCCAGGTACTTCTACTGAACCGTCCGAG GGCAGCGCACCA | 378 |
| LCW0402_041_GFP-N_G10.ab1 | GTSTEPSEGSAPGSP AGSPTSTEEGTSTEP SEGSAP | 342 | GGTACTTCTACCGAACCGTCCGAGGGTAGCGC ACCAGGTAGCCCAGCAGGTTCTCCTACCTCCA CCGAGGAAGGTACTTCTACCGAACCGTCCGAG GGTAGCGCACCA | 379 |
| LCW0402_050_GFP-N_A11.ab1 | GSEPATSGSETPGT SESATPESGPGSEPA TSGSETP | 343 | GGTAGCGAACCGGCAACCTCCGGCTCTGAAAC TCCAGGTACTTCTGAAAGCGCTACTCCGGAAT CCGGCCCAGGTAGCGAACCGGCTACTTCCGGC TCTGAAACCCCA | 380 |

TABLE 12-continued

DNA and Amino Acid Sequences for 36-mer motifs

| File name | Amino acid sequence | SEQ ID NO: | Nucleotide sequence | SEQ ID NO: |
|---|---|---|---|---|
| LCW0402_051_GFP-N_B11.ab1 | GSEPATSGSETPGT SESATPESGPGSEPA TSGSETP | 344 | GGTAGCGAACCGGCAACTTCCGGCTCTGAAAC CCCAGGTACTTCTGAAAGCGCTACTCCTGAGT CTGGCCCAGGTAGCGAACCTGCTACCTCTGGC TCTGAAACCCCA | 381 |
| LCW0402_059_GFP-N_E11.ab1 | GSEPATSGSETPGS EPATSGSETPGTSTE PSEGSAP | 345 | GGTAGCGAACCGGCAACCTCTGGCTCTGAAAC TCCAGGTAGCGAACCTGCAACCTCCGGCTCTG AAACCCCAGGTACTTCTACTGAACCTTCTGAG GGCAGCGCACCA | 382 |
| LCW0402_060_GFP-N_F11.ab1 | GTSESATPESGPGS EPATSGSETPGSEP ATSGSETP | 346 | GGTACTTCTGAAAGCGCTACCCCGGAATCTGG CCCAGGTAGCGAACCGGCTACTTCTGGTTCTG AAACCCCAGGTAGCGAACCGGCTACCTCCGGT TCTGAAACTCCA | 383 |
| LCW0402_061_GFP-N_G11.ab1 | GTSTEPSEGSAPGT STEPSEGSAPGTSES ATPESGP | 347 | GGTACCTCTACTGAACCTTCCGAAGGCAGCGC TCCAGGTACCTCTACCGAACCGTCCGAGGGCA GCGCACCAGGTACTTCTGAAAGCGCAACCCCT GAATCCGGTCCA | 384 |
| LCW0402_065_GFP-N_A12.ab1 | GSEPATSGSETPGT SESATPESGPGTSES ATPESGP | 348 | GGTAGCGAACCGGCAACCTCTGGCTCTGAAAC CCCAGGTACCTCTGAAAGCGCTACTCCGGAAT CTGGTCCAGGTACTTCTGAAAGCGCTACTCCG GAATCCGGTCCA | 385 |
| LCW0402_066_GFP-N_B12.ab1 | GSEPATSGSETPGS EPATSGSETPGTSTE PSEGSAP | 349 | GGTAGCGAACCTGCTACCTCCGGCTCTGAAAC TCCAGGTAGCGAACCGGCTACTTCCGGTTCTG AAACTCCAGGTACCTCTACCGAACCTTCCGAA GGCAGCGCACCA | 386 |
| LCW0402_067_GFP-N_C12.ab1 | GSEPATSGSETPGT STEPSEGSAPGSEPA TSGSETP | 350 | GGTAGCGAACCTGCTACTTCTGGTTCTGAAACT CCAGGTACTTCTACCGAACCGTCCGAGGGTAG CGCTCCAGGTAGCGAACCTGCTACTTCTGGTTC TGAAACTCCA | 387 |
| LCW0402_069_GFP-N_D12.ab1 | GTSTEPSEGSAPGT STEPSEGSAPGSEPA TSGSETP | 351 | GGTACCTCTACCGAACCGTCCGAGGGTAGCGC ACCAGGTACCTCTACTGAACCGTCTGAGGGTA GCGCTCCAGGTAGCGAACCGGCAACCTCCGGT TCTGAAACTCCA | 388 |
| LCW0402_073_GFP-N_F12.ab1 | GTSTEPSEGSAPGS EPATSGSETPGSPA GSPTSTEE | 352 | GGTACTTCTACTGAACCTTCCGAAGGTAGCGC TCCAGGTAGCGAACCTGCTACTTCTGGTTCTGA AACCCCAGGTAGCCCGGCTGGCTCTCCGACCT CCACCGAGGAA | 389 |
| LCW0402_074_GFP-N_G12.ab1 | GSEPATSGSETPGSP AGSPTSTEEGTSES ATPESGP | 353 | GGTAGCGAACCGGCTACTTCCGGCTCTGAGAC TCCAGGTAGCCCAGCTGGTTCTCCAACCTCTAC TGAGGAAGGTACTTCTGAAAGCGCTACCCCTG AATCTGGTCCA | 390 |
| LCW0402_075_GFP-N_H12.ab1 | GTSESATPESGPGS EPATSGSETPGTSES ATPESGP | 354 | GGTACCTCTGAAAGCGCAACTCCTGAGTCTGG CCCAGGTAGCGAACCTGCTACCTCCGGCTCTG AGACTCCAGGTACCTCTGAAAGCGCAACCCCG GAATCTGGTCCA | 391 |

Example 3

Construction of XTEN_AF36 Segments

A codon library encoding sequences of 36 amino acid length was constructed. The sequences were designated XTEN_AF36. Its segments have the amino acid sequence [X]$_3$ where X is a 12mer peptide with the sequence: GST-SESPSGTAP (SEQ ID NO: 10), GTSTPESGSASP (SEQ ID NO: 11), GTSPSGESSTAP (SEQ ID NO: 12), or GSTSS-TAESPGP (SEQ ID NO: 13). The insert was obtained by annealing the following pairs of phosphorylated synthetic oligonucleotide pairs:

AF1for:
(SEQ ID NO: 392)
AGGTTCTACYAGCGAATCYCCKTCTGGYACYGCWCC

AF1rev:
(SEQ ID NO: 393)
ACCTGGWGCRGTRCCAGAMGGRGATTCGCTRGTAGA

AF2for:
(SEQ ID NO: 394)
AGGTACYTCTACYCCKGAAAGCGGYTCYGCWTCTCC

AF2rev:
(SEQ ID NO: 395)
ACCTGGAGAWGCRGARCCGCTTTCMGGRGTAGARGT

-continued

AF3for:
(SEQ ID NO: 396)
AGGTACYTCYCCKAGCGGYGAATCTTCTACYGCWCC

AF3rev:
(SEQ ID NO: 397)
ACCTGGWGCRGTAGAAGATTCRCCGCTMGGRGARGT

AF4for:
(SEQ ID NO: 398)
AGGTTCYACYAGCTCTACYGCWGAATCTCCKGGYCC

AF4rev:
(SEQ ID NO: 399)
ACCTGGRCCMGGAGATTCWGCRGTAGAGCTRGTRGA

We also annealed the phosphorylated oligonucleotide 3KpnIstopperFor: AGGTTCGTCTTCACTCGAGGGTAC (SEQ ID NO: 232) and the non-phosphorylated oligonucleotide pr_3 KpnIstopperRev: CCTCGAGTGAAGACGA (SEQ ID NO: 233). The annealed oligonucleotide pairs were ligated, which resulted in a mixture of products with varying length that represents the varying number of 12mer repeats ligated to one BbsI/KpnI segment. The products corresponding to the length of 36 amino acids were isolated from the mixture by preparative agarose gel electrophoresis and ligated into the BsaI/KpnI digested stuffer vector pCW0359. Most of the clones in the resulting library designated LCW0403 showed green fluorescence after induction which shows that the sequence of XTEN_AF36 had been ligated in frame with the GFP gene and most sequences of XTEN_AF36 show good expression.

We screened 96 isolates from library LCW0403 for high level of fluorescence by stamping them onto agar plate containing IPTG. The same isolates were evaluated by PCR and 48 isolates were identified that contained segments with 36 amino acids as well as strong fluorescence. These isolates were sequenced and 44 clones were identified that contained correct XTEN_AF36 segments. The file names of the nucleotide and amino acid constructs and the sequences for these segments are listed in Table 13.

TABLE 13

DNA and Amino Acid Sequences for 36-mer motifs

| File name | Amino acid sequence | SEQ ID NO: | Nucleotide sequence | SEQ ID NO: |
|---|---|---|---|---|
| LCW0403_004_GFP-N_A01.ab1 | GTSTPESGSASPGTS PSGESSTAPGTSPSG ESSTAP | 400 | GGTACTTCTACTCCGGAAAGCGGTTCCGCATCT CCAGGTACTTCTCCTAGCGGTGAATCTTCTACT GCTCCAGGTACCTCTCCTAGCGGCGAATCTTCT ACTGCTCCA | 444 |
| LCW0403_005_GFP-N_B01.ab1 | GTSPSGESSTAPGST SSTAESPGPGTSPSG ESSTAP | 401 | GGTACTTCTCCGAGCGGTGAATCTTCTACCGCA CCAGGTTCTACTAGCTCTACCGCTGAATCTCCG GGCCCAGGTACTTCTCCGAGCGGTGAATCTTCT ACTGCTCCA | 445 |
| LCW0403_006_GFP-N_C01.ab1 | GSTSSTAESPGPGTS PSGESSTAPGTSTPES GSASP | 402 | GGTTCCACCAGCTCTACTGCTGAATCTCCTGGT CCAGGTACCTCTCCTAGCGGTGAATCTTCTACT GCTCCAGGTACTTCTACTCCTGAAAGCGGCTCT GCTTCTCCA | 446 |
| LCW0403_007_GFP-N_D01.ab1 | GSTSSTAESPGPGST SSTAESPGPGTSPSG ESSTAP | 403 | GGTTCTACCAGCTCTACTGCAGAATCTCCTGGC CCAGGTTCCACCAGCTCTACCGCAGAATCTCCG GGTCCAGGTACTTCCCCTAGCGGTGAATCTTCT ACCGCACCA | 447 |
| LCW0403_008_GFP-N_E01.ab1 | GSTSSTAESPGPGTS PSGESSTAPGTSTPES GSASP | 404 | GGTTCTACTAGCTCTACTGCTGAATCTCCTGGCC CAGGTACTTCTCCTAGCGGTGAATCTTCTACCG CTCCAGGTACCTCTACTCCGGAAAGCGGTTCTG CATCTCCA | 448 |
| LCW0403_010_GFP-N_F01.ab1 | GSTSSTAESPGPGTS TPESGSASPGSTSESP SGTAP | 405 | GGTTCTACCAGCTCTACCGCAGAATCTCCTGGT CCAGGTACCTCTACTCCGGAAAGCGGCTCTGCA TCTCCAGGTTCTACTAGCGAATCTCCTTCTGGCA CTGCACCA | 449 |
| LCW0403_011_GFP-N_G01.ab1 | GSTSSTAESPGPGTS TPESGSASPGTSTPES GSASP | 406 | GGTTCTACTAGCTCTACTGCAGAATCTCCTGGC CCAGGTACCTCTACTCCGGAAAGCGGCTCTGCA TCTCCAGGTACTTCTACCCCTGAAAGCGGTTCT GCATCTCCA | 450 |
| LCW0403_012_GFP-N_H01.ab1 | GSTSESPSGTAPGTS PSGESSTAPGSTSESP SGTAP | 407 | GGTTCTACCAGCGAATCTCCTTCTGGCACCGCT CCAGGTACCTCTCCTAGCGGCGAATCTTCTACC GCTCCAGGTTCTACTAGCGAATCTCCTTCTGGC ACTGCACCA | 451 |
| LCW0403_013_GFP-N_A02.ab1 | GSTSSTAESPGPGST SSTAESPGPGTSPSG ESSTAP | 408 | GGTTCCACCAGCTCTACTGCAGAATCTCCGGGC CCAGGTTCTACTAGCTCTACTGCAGAATCTCCG GGTCCAGGTACTTCTCCTAGCGGCGAATCTTCT ACCGCTCCA | 452 |

TABLE 13-continued

DNA and Amino Acid Sequences for 36-mer motifs

| File name | Amino acid sequence | SEQ ID NO: | Nucleotide sequence | SEQ ID NO: |
|---|---|---|---|---|
| LCW0403_014_GFP-N_B02.ab1 | GSTSSTAESPGPGTS TPESGSASPGSTSESP SGTAP | 409 | GGTTCCACTAGCTCTACTGCAGAATCTCCTGGC CCAGGTACCTCTACCCCTGAAAGCGGCTCTGCA TCTCCAGGTTCTACCAGCGAATCCCCGTCTGGC ACCGCACCA | 453 |
| LCW0403_015_GFP-N_C02.ab1 | GSTSSTAESPGPGST SSTAESPGPGTSPSG ESSTAP | 410 | GGTTCTACTAGCTCTACTGCTGAATCTCCGGGT CCAGGTTCTACCAGCTCTACTGCTGAATCTCCT GGTCCAGGTACCTCCCCGAGCGGTGAATCTTCT ACTGCACCA | 454 |
| LCW0403_017_GFP-N_D02.ab1 | GSTSSTAESPGPGST SESPSGTAPGSTSST AESPGP | 411 | GGTTCTACCAGCTCTACCGCTGAATCTCCTGGC CCAGGTTCTACCAGCGAATCCCCGTCTGGCACC GCACCAGGTTCTACTAGCTCTACCGCTGAATCT CCGGGTCCA | 455 |
| LCW0403_018_GFP-N_E02.ab1 | GSTSSTAESPGPGST SSTAESPGPGSTSST AESPGP | 412 | GGTTCTACCAGCTCTACCGCAGAATCTCCTGGC CCAGGTTCCACTAGCTCTACCGCTGAATCTCCT GGTCCAGGTTCTACTAGCTCTACCGCTGAATCT CCTGGTCCA | 456 |
| LCW0403_019_GFP-N_F02.ab1 | GSTSESPSGTAPGST SSTAESPGPGSTSST AESPGP | 413 | GGTTCTACTAGCGAATCCCCTTCTGGTACTGCTC CAGGTTCCACTAGCTCTACCGCTGAATCTCCTG GCCCAGGTTCCACTAGCTCTACTGCAGAATCTC CTGGTCCA | 457 |
| LCW0403_023_GFP-N_H02.ab1 | GSTSESPSGTAPGST SESPSGTAPGSTSESP SGTAP | 414 | GGTTCTACTAGCGAATCTCCTTCTGGTACCGCTC CAGGTTCTACCAGCGAATCCCCGTCTGGTACTG CTCCAGGTTCTACCAGCGAATCTCCTTCTGGTA CTGCACCA | 458 |
| LCW0403_024_GFP-N_A03.ab1 | GSTSSTAESPGPGST SSTAESPGPGSTSST AESPGP | 415 | GGTTCCACCAGCTCTACTGCTGAATCTCCTGGC CCAGGTTCTACCAGCTCTACTGCTGAATCTCCG GGCCCAGGTTCCACCAGCTCTACCGCTGAATCT CCGGGTCCA | 459 |
| LCW0403_025_GFP-N_B03.ab1 | GSTSSTAESPGPGST SSTAESPGPGTSPSG ESSTAP | 416 | GGTTCCACTAGCTCTACCGCAGAATCTCCTGGT CCAGGTTCTACTAGCTCTACTGCTGAATCTCCG GGTCCAGGTACCTCCCCTAGCGGCGAATCTTCT ACCGCTCCA | 460 |
| LCW0403_028_GFP-N_D03.ab1 | GSSPSASTGTGPGSS TPSGATGSPGSSTPS GATGSP | 417 | GGTTCTAGCCCTTCTGCTTCCACCGGTACCGGC CCAGGTAGCTCTACTCCGTCTGGTGCAACTGGC TCTCCAGGTAGCTCTACTCCGTCTGGTGCAACC GGCTCCCCA | 461 |
| LCW0403_029_GFP-N_E03.ab1 | GTSPSGESSTAPGTS TPESGSASPGSTSST AESPGP | 418 | GGTACTTCCCCTAGCGGTGAATCTTCTACTGCTC CAGGTACCTCTACTCCGGAAAGCGGCTCCGCAT CTCCAGGTTCTACTAGCTCTACTGCTGAATCTCC TGGTCCA | 462 |
| LCW0403_030_GFP-N_F03.ab1 | GSTSSTAESPGPGST SSTAESPGPGTSTPES GSASP | 419 | GGTTCTACTAGCTCTACCGCTGAATCTCCGGGT CCAGGTTCTACCAGCTCTACTGCAGAATCTCCT GGCCCAGGTACTTCTACTCCGGAAAGCGGTTCC GCTTCTCCA | 463 |
| LCW0403_031_GFP-N_G03.ab1 | GTSPSGESSTAPGST SSTAESPGPGTSTPES GSASP | 420 | GGTACTTCTCCTAGCGGTGAATCTTCTACCGCTC CAGGTTCTACCAGCTCTACTGCTGAATCTCCTG GCCCAGGTACTTCTACCCCGGAAAGCGGCTCCG CTTCTCCA | 464 |
| LCW0403_033_GFP-N_H03.ab1 | GSTSESPSGTAPGST SSTAESPGPGSTSST AESPGP | 421 | GGTTCTACTAGCGAATCCCCTTCTGGTACTGCA CCAGGTTCTACCAGCTCTACTGCTGAATCTCCG GGCCCAGGTTCCACCAGCTCTACCGCAGAATCT CCTGGTCCA | 465 |
| LCW0403_035_GFP-N_A04.ab1 | GSTSSTAESPGPGST SESPSGTAPGSTSST AESPGP | 422 | GGTTCCACCAGCTCTACCGCTGAATCTCCGGGC CCAGGTTCTACCAGCGAATCCCCTTCTGGCACT GCACCAGGTTCTACTAGCTCTACCGCAGAATCT CCGGGCCCA | 466 |
| LCW0403_036_GFP-N_B04.ab1 | GSTSSTAESPGPGTS PSGESSTAPGTSTPES GSASP | 423 | GGTTCTACCAGCTCTACTGCTGAATCTCCGGGT CCAGGTACTTCCCCGAGCGGTGAATCTTCTACT GCACCAGGTACTTCTACTCCGGAAAGCGGTTCC GCTTCTCCA | 467 |

TABLE 13-continued

DNA and Amino Acid Sequences for 36-mer motifs

| File name | Amino acid sequence | SEQ ID NO: | Nucleotide sequence | SEQ ID NO: |
|---|---|---|---|---|
| LCW0403_039_GFP-N_C04.ab1 | GSTSESPSGTAPGSTSESPSGTAPGTSPSGESSTAP | 424 | GGTTCTACCAGCGAATCTCCTTCTGGCACCGCTCCAGGTTCTACTAGCGAATCCCCGTCTGGTACCGCACCAGGTACTTCTCCTAGCGGCGAATCTTCTACCGCACCA | 468 |
| LCW0403_041_GFP-N_D04.ab1 | GSTSESPSGTAPGSTSESPSGTAPGTSTPESGSASP | 425 | GGTTCTACCAGCGAATCCCCTTCTGGTACTGCTCCAGGTTCTACCAGCGAATCCCCTTCTGGCACCGCACCAGGTACTTCTACCCCTGAAAGCGGCTCCGCTTCTCCA | 469 |
| LCW0403_044_GFP-N_E04.ab1 | GTSTPESGSASPGSTSSTAESPGPGSTSSTAESPGP | 426 | GGTACCTCTACTCCTGAAAGCGGTTCTGCATCTCCAGGTTCCACTAGCTCTACCGCAGAATCTCCGGGCCCAGGTTCTACTAGCTCTACTGCTGAATCTCCTGGCCCA | 470 |
| LCW0403_046_GFP-N_F04.ab1 | GSTSESPSGTAPGSTSESPSGTAPGTSPSGESSTAP | 427 | GGTTCTACCAGCGAATCCCCTTCTGGCACTGCACCAGGTTCTACTAGCGAATCCCCTTCTGGTACCGCACCAGGTACTTCTCCGAGCGGCGAATCTTCTACTGCTCCA | 471 |
| LCW0403_047_GFP-N_G04.ab1 | GSTSSTAESPGPGSTSSTAESPGPGSTSESPSGTAP | 428 | GGTTCTACTAGCTCTACCGCTGAATCTCCTGGCCCAGGTTCCACTAGCTCTACCGCAGAATCTCCGGGCCCAGGTTCTACTAGCGAATCCCCTTCTGGTACCGCTCCA | 472 |
| LCW0403_049_GFP-N_H04.ab1 | GSTSSTAESPGPGSTSSTAESPGPGTSTPESGSASP | 429 | GGTTCCACCAGCTCTACTGCAGAATCTCCTGGCCCAGGTTCTACTAGCTCTACCGCAGAATCTCCTGGTCCAGGTACCTCTACTCCTGAAAGCGGTTCCGCATCTCCA | 473 |
| LCW0403_051_GFP-N_A05.ab1 | GSTSSTAESPGPGSTSSTAESPGPGSTSESPSGTAP | 430 | GGTTCTACTAGCTCTACTGCTGAATCTCCGGGCCCAGGTTCTACTAGCTCTACCGCTGAATCTCCGGGTCCAGGTTCTACTAGCGAATCTCCTTCTGGTACCGCTCCA | 474 |
| LCW0403_053_GFP-N_B05.ab1 | GTSPSGESSTAPGSTSESPSGTAPGSTSSTAESPGP | 431 | GGTACCTCCCCGAGCGGTGAATCTTCTACTGCACCAGGTTCTACTAGCGAATCCCCTTCTGGTACTGCTCCAGGTTCCACCAGCTCTACTGCAGAATCTCCGGGTCCA | 475 |
| LCW0403_054_GFP-N_C05.ab1 | GSTSESPSGTAPGTSPSGESSTAPGSTSSTAESPGP | 432 | GGTTCTACTAGCGAATCCCCGTCTGGTACTGCTCCAGGTACTTCCCCTAGCGGTGAATCTTCTACTGCTCCAGGTTCTACCAGCTCTACCGCAGAATCTCCGGGTCCA | 476 |
| LCW0403_057_GFP-N_D05.ab1 | GSTSSTAESPGPGSTSESPSGTAPGTSPSGESSTAP | 433 | GGTTCTACCAGCTCTACCGCTGAATCTCCTGGCCCAGGTTCTACTAGCGAATCTCCGTCTGGCACCGCACCAGGTACTTCCCCTAGCGGTGAATCTTCTACTGCACCA | 477 |
| LCW0403_058_GFP-N_E05.ab1 | GSTSESPSGTAPGSTSESPSGTAPGTSTPESGSASP | 434 | GGTTCTACTAGCGAATCTCCTTCTGGCACTGCACCAGGTTCTACCAGCGAATCTCCGTCTGGCACTGCACCAGGTACCTCTACCCCTGAAAGCGGTTCCGCTTCTCCA | 478 |
| LCW0403_060_GFP-N_F05.ab1 | GTSTPESGSASPGSTSESPSGTAPGSTSSTAESPGP | 435 | GGTACCTCTACTCCGGAAAGCGGTTCCGCATCTCCAGGTTCTACCAGCGAATCCCCGTCTGGCACCGCACCAGGTTCTACTAGCTCTACTGCTGAATCCCGGGCCCA | 479 |
| LCW0403_063_GFP-N_G05.ab1 | GSTSSTAESPGPGTSPSGESSTAPGTSPSGESSTAP | 436 | GGTTCTACTAGCTCTACTGCAGAATCTCCGGGCCCAGGTACCTCTCCTAGCGGTGAATCTTCTACCGCTCCAGGTACTTCTCCGAGCGGTGAATCTTCTACCGCTCCA | 480 |
| LCW0403_064_GFP-N_H05.ab1 | GTSPSGESSTAPGTSPSGESSTAPGTSPSGESSTAP | 437 | GGTACCTCCCCTAGCGGCGAATCTTCTACTGCTCCAGGTACCTCTCCTAGCGGCGAATCTTCTACCGCTCCAGGTACCTCCCCTAGCGGTGAATCTTCTACCGCACCA | 481 |
| LCW0403_065_GFP-N_A06.ab1 | GSTSSTAESPGPGTSTPESGSASPGSTSESPSGTAP | 438 | GGTTCCACTAGCTCTACTGCTGAATCTCCTGGCCAGGTACTTCTACTCCGGAAAGCGGTTCCGCTTCTCCAGGTTCTACTAGCGAATCTCCGTCTGGCACCGCACCA | 482 |

TABLE 13-continued

DNA and Amino Acid Sequences for 36-mer motifs

| File name | Amino acid sequence | SEQ ID NO: | Nucleotide sequence | SEQ ID NO: |
|---|---|---|---|---|
| LCW0403_066_GFP-N_B06.ab1 | GSTSESPSGTAPGTS PSGESSTAPGTSPSG ESSTAP | 439 | GGTTCTACTAGCGAATCTCCGTCTGGCACTGCT CCAGGTACTTCTCCTAGCGGTGAATCTTCTACC GCTCCAGGTACTTCCCCTAGCGGCGAATCTTCT ACCGCTCCA | 483 |
| LCW0403_067_GFP-N_C06.ab1 | GSTSESPSGTAPGTS TPESGSASPGSTSST AESPGP | 440 | GGTTCTACTAGCGAATCTCCTTCTGGTACCGCTC CAGGTACTTCTACCCCTGAAAGCGGCTCCGCTT CTCCAGGTTCCACTAGCTCTACCGCTGAATCTC CGGGTCCA | 484 |
| LCW0403_068_GFP-N_D06.ab1 | GSTSSTAESPGPGST SSTAESPGPGSTSESP SGTAP | 441 | GGTTCCACTAGCTCTACTGCTGAATCTCCTGGC CCAGGTTCTACCAGCTCTACCGCTGAATCTCCT GGCCCAGGTTCTACCAGCGAATCTCCGTCTGGC ACCGCACCA | 485 |
| LCW0403_069_GFP-N_E06.ab1 | GSTSESPSGTAPGTS TPESGSASPGTSTPES GSASP | 442 | GGTTCTACTAGCGAATCCCCGTCTGGTACCGCA CCAGGTACTTCTACCCCGGAAAGCGGCTCTGCT TCTCCAGGTACTTCTACCCCGGAAAGCGGCTCC GCATCTCCA | 486 |
| LCW0403_070_GFP-N_F06.ab1 | GSTSESPSGTAPGTS TPESGSASPGTSTPES GSASP | 443 | GGTTCTACTAGCGAATCCCCGTCTGGTACTGCT CCAGGTACTTCTACTCCTGAAAGCGGTTCCGCT TCTCCAGGTACCTCTACTCCGGAAAGCGGTTCT GCATCTCCA | 487 |

Example 4

Construction of XTEN_AG36 Segments

A codon library encoding sequences of 36 amino acid length was constructed. The sequences were designated XTEN_AG36. Its segments have the amino acid sequence [X]$_3$ where X is a 12mer peptide with the sequence: GTPGS-GTASSSP (SEQ ID NO: 14), GSSTPSGATGSP (SEQ ID NO: 15), GSSPSASTGTGP (SEQ ID NO: 16), or GASPGTSSTGSP (SEQ ID NO: 17). The insert was obtained by annealing the following pairs of phosphorylated synthetic oligonucleotide pairs:

```
AG1for:
                                  (SEQ ID NO: 488)
AGGTACYCCKGGYAGCGGTACYGCWTCTTCYTCTCC AG1rev:
                                  (SEQ ID NO: 489)
ACCTGGAGARGAAGAWGCRGTACCGCTRCCMGGRGT AG2for:
                                  (SEQ ID NO: 490)
AGGTAGCTCTACYCCKTCTGGTGCWACYGGYTCYCC AG2rev:
                                  (SEQ ID NO: 491)
ACCTGGRGARCCRGTWGCACCAGAMGGRGTAGAGCT AG3for:
                                  (SEQ ID NO: 492)
AGGTTCTAGCCCKTCTGCWTCYACYGGTACYGGYCC AG3rev:
                                  (SEQ ID NO: 493)
ACCTGGRCCRGTACCRGTRGAWGCAGAMGGGCTAGA AG4for:
                                  (SEQ ID NO: 494)
AGGTGCWTCYCCKGGYACYAGCTCTACYGGTTCTCC AG4rev:
                                  (SEQ ID NO: 495)
ACCTGGAGAACCRGTAGAGCTRGTRCCMGGRGAWGC
```

We also annealed the phosphorylated oligonucleotide 3 KpnIstopperFor: AGGTTCGTCTTCACTCGAGGGTAC (SEQ ID NO: 232) and the non-phosphorylated oligonucleotide pr_3KpnIstopperRev: CCTCGAGTGAAGACGA (SEQ ID NO: 233). The annealed oligonucleotide pairs were ligated, which resulted in a mixture of products with varying length that represents the varying number of 12mer repeats ligated to one BbsI/KpnI segment. The products corresponding to the length of 36 amino acids were isolated from the mixture by preparative agarose gel electrophoresis and ligated into the BsaI/KpnI digested stuffer vector pCW0359. Most of the clones in the resulting library designated LCW0404 showed green fluorescence after induction which shows that the sequence of XTEN_AG36 had been ligated in frame with the GFP gene and most sequences of XTEN_AG36 show good expression.

We screened 96 isolates from library LCW0404 for high level of fluorescence by stamping them onto agar plate containing IPTG. The same isolates were evaluated by PCR and 48 isolates were identified that contained segments with 36 amino acids as well as strong fluorescence. These isolates were sequenced and 44 clones were identified that contained correct XTEN_AG36 segments. The file names of the nucleotide and amino acid constructs and the sequences for these segments are listed in Table 14.

TABLE 14

DNA and Amino Acid Sequences for 36-mer motifs

| File name | Amino acid sequence | SEQ ID NO: | Nucleotide sequence | SEQ ID NO: |
|---|---|---|---|---|
| LCW0404_001_GFP-N_A07.ab1 | GASPGTSSTGSPGTPG SGTASSSPGSSTPSGA TGSP | 496 | GGTGCATCCCCGGGCACTAGCTCTACCGGTT CTCCAGGTACTCCTGGTAGCGGTACTGCTTC TTCTTCTCCAGGTAGCTCTACTCCTTCTGGTG CTACTGGTTCTCCA | 540 |
| LCW0404_003_GFP-N_B07.ab1 | GSSTPSGATGSPGSSP SASTGTGPGSSTPSGA TGSP | 497 | GGTAGCTCTACCCCTTCTGGTGCTACCGGCT CTCCAGGTTCTAGCCCGTCTGCTTCTACCGGT ACCGGTCCAGGTAGCTCTACCCCTTCTGGTG CTACTGGTTCTCCA | 541 |
| LCW0404_006_GFP-N_C07.ab1 | GASPGTSSTGSPGSSP SASTGTGPGSSTPSGA TGSP | 498 | GGTGCATCTCCGGGTACTAGCTCTACCGGTT CTCCAGGTTCTAGCCCTTCTGCTTCCACTGGT ACCGGCCCAGGTAGCTCTACCCCGTCTGGTG CTACTGGTTCCCCA | 542 |
| LCW0404_007_GFP-N_D07.ab1 | GTPGSGTASSSPGSST PSGATGSPGASPGTSS TGSP | 499 | GGTACTCCGGGCAGCGGTACTGCTTCTTCCT CTCCAGGTAGCTCTACCCCTTCTGGTGCAAC TGGTTCCCCAGGTGCATCCCCTGGTACTAGC TCTACCGGTTCTCCA | 543 |
| LCW0404_009_GFP-N_E07.ab1 | GTPGSGTASSSPGASP GTSSTGSPGSRPSAST GTGP | 500 | GGTACCCCTGGCAGCGGTACTGCTTCTTCTTC TCCAGGTGCTTCCCCTGGTACCAGCTCTACC GGTTCTCCAGGTTCTAGACCTTCTGCATCCAC CGGTACTGGTCCA | 544 |
| LCW0404_011_GFP-N_F07.ab1 | GASPGTSSTGSPGSST PSGATGSPGASPGTSS TGSP | 501 | GGTGCATCTCCTGGTACCAGCTCTACCGGTT CTCCAGGTAGCTCTACTCCTTCTGGTGCTACT GGCTCTCCAGGTGCTTCCCCGGGTACCAGCT CTACCGGTTCTCCA | 545 |
| LCW0404_012_GFP-N_G07.ab1 | GTPGSGTASSSPGSST PSGATGSPGSSTPSGA TGSP | 502 | GGTACCCCGGGCAGCGGTACCGCATCTTCCT CTCCAGGTAGCTCTACCCCGTCTGGTGCTAC CGGTTCCCCAGGTAGCTCTACCCCGTCTGGT GCAACCGGCTCCCCA | 546 |
| LCW0404_014_GFP-N_H07.ab1 | GASPGTSSTGSPGASP GTSSTGSPGASPGTSS TGSP | 503 | GGTGCATCTCCGGGCACTAGCTCTACTGGTT CTCCAGGTGCATCCCCTGGCACTAGCTCTAC TGGTTCTCCAGGTGCTTCTCCTGGTACCAGCT CTACTGGTTCTCCA | 547 |
| LCW0404_015_GFP-N_A08.ab1 | GSSTPSGATGSPGSSP SASTGTGPGASPGTSS TGSP | 504 | GGTAGCTCTACTCCGTCTGGTGCAACCGGCT CCCCAGGTTCTAGCCCGTCTGCTTCCACTGGT ACTGGCCCAGGTGCTTCCCCGGGCACCAGCT CTACTGGTTCTCCA | 548 |
| LCW0404_016_GFP-N_B08.ab1 | GSSTPSGATGSPGSST PSGATGSPGTPGSGT ASSSP | 505 | GGTAGCTCTACTCCTTCTGGTGCTACCGGTTC CCCAGGTAGCTCTACTCCTTCTGGTGCTACTG GTTCCCCAGGTACTCCGGGCAGCGGTACTGC TTCTTCCTCTCCA | 549 |
| LCW0404_017_GFP-N_C08.ab1 | GSSTPSGATGSPGSST PSGATGSPGASPGTSS TGSP | 506 | GGTAGCTCTACTCCGTCTGGTGCAACCGGTT CCCCAGGTAGCTCTACTCCTTCTGGTGCTACT GGCTCTCCAGGTGCATCCCCTGGCACCAGCT CTACCGGTTCTCCA | 550 |
| LCW0404_018_GFP-N_D08.ab1 | GTPGSGTASSSPGSSP SASTGTGPGSSTPSGA TGSP | 507 | GGTACTCCTGGTAGCGGTACCGCATCTTCCT CTCCAGGTTCTAGCCCTTCTGCATCTACCGGT ACCGGTCCAGGTAGCTCTACTCCTTCTGGTG CTACTGGCTCTCCA | 551 |
| LCW0404_023_GFP-N_F08.ab1 | GASPGTSSTGSPGSSP SASTGTGPGTPGSGT ASSSP | 508 | GGTGCTTCCCCGGGCACTAGCTCTACCGGTT CTCCAGGTTCTAGCCCTTCTGCATCTACTGGT ACTGGCCCAGGTACTCCGGGCAGCGGTACTG CTTCTTCCTCTCCA | 552 |
| LCW0404_025_GFP-N_G08.ab1 | GSSTPSGATGSPGSST PSGATGSPGASPGTSS TGSP | 509 | GGTAGCTCTACTCCGTCTGGTGCTACCGGCT CTCCAGGTAGCTCTACCCCTTCTGGTGCAAC CGGCTCCCCAGGTGCTTCTCCGGGTACCAGC TCTACTGGTTCTCCA | 553 |
| LCW0404_029_GFP-N_A09.ab1 | GTPGSGTASSSPGSST PSGATGSPGSSPSAST GTGP | 510 | GGTACCCCTGGCAGCGGTACCGCTTCTTCCT CTCCAGGTAGCTCTACCCCGTCTGGTGCTAC TGGCTCTCCAGGTTCTAGCCCGTCTGCATCTA CCGGTACCGGCCCA | 554 |

TABLE 14-continued

DNA and Amino Acid Sequences for 36-mer motifs

| File name | Amino acid sequence | SEQ ID NO: | Nucleotide sequence | SEQ ID NO: |
|---|---|---|---|---|
| LCW0404_030_GFP-N_B09.ab1 | GSSTPSGATGSPGTPG SGTASSSPGTPGSGTA SSSP | 511 | GGTAGCTCTACTCCTTCTGGTGCAACCGGCT CCCCAGGTACCCCGGGCAGCGGTACCGCATC TTCCTCTCCAGGTACTCCGGGTAGCGGTACT GCTTCTTCTTCTCCA | 555 |
| LCW0404_031_GFP-N_C09.ab1 | GTPGSGTASSSPGSST PSGATGSPGASPGTSS TGSP | 512 | GGTACCCCGGGTAGCGGTACTGCTTCTTCCT CTCCAGGTAGCTCTACCCCTTCTGGTGCAAC CGGCTCTCCAGGTGCTTCTCCGGGCACCAGC TCTACCGGTTCTCCA | 556 |
| LCW0404_034_GFP-N_D09.ab1 | GSSTPSGATGSPGSST PSGATGSPGASPGTSS TGSP | 513 | GGTAGCTCTACCCCGTCTGGTGCTACCGGCT CTCCAGGTAGCTCTACCCCGTCTGGTGCAAC CGGCTCCCCAGGTGCATCCCCGGGTACTAGC TCTACCGGTTCTCCA | 557 |
| LCW0404_035_GFP-N_E09.ab1 | GASPGTSSTGSPGTPG SGTASSSPGSSTPSGA TGSP | 514 | GGTGCTTCTCCGGGCACCAGCTCTACTGGTT CTCCAGGTACCCCGGGCAGCGGTACCGCATC TTCTTCTCCAGGTAGCTCTACTCCTTCTGGTG CAACTGGTTCTCCA | 558 |
| LCW0404_036_GFP-N_F09.ab1 | GSSPSASTGTGPGSST PSGATGSPGTPGSGT ASSSP | 515 | GGTTCTAGCCCGTCTGCTTCCACCGGTACTG GCCCAGGTAGCTCTACCCCGTCTGGTGCAAC TGGTTCCCCAGGTACCCCTGGTAGCGGTACC GCTTCTTCTTCTCCA | 559 |
| LCW0404_037_GFP-N_G09.ab1 | GASPGTSSTGSPGSSP SASTGTGPGSSTPSGA TGSP | 516 | GGTGCTTCTCCGGGCACCAGCTCTACTGGTT CTCCAGGTTCTAGCCCTTCTGCATCCACCGGT ACCGGTCCAGGTAGCTCTACCCCTTCTGGTG CAACCGGCTCTCCA | 560 |
| LCW0404_040_GFP-N_H09.ab1 | GASPGTSSTGSPGSST PSGATGSPGSSTPSGA TGSP | 517 | GGTGCATCCCCGGGCACCAGCTCTACCGGTT CTCCAGGTAGCTCTACCCCGTCTGGTGCTAC CGGCTCTCCAGGTAGCTCTACCCCGTCTGGT GCTACTGGCTCTCCA | 561 |
| LCW0404_041_GFP-N_A10.ab1 | GTPGSGTASSSPGSST PSGATGSPGTPGSGT ASSSP | 518 | GGTACCCCTGGTAGCGGTACTGCTTCTTCCTC TCCAGGTAGCTCTACTCCGTCTGGTGCTACC GGTTCTCCAGGTACCCCGGGTAGCGGTACCG CATCTTCTTCTCCA | 562 |
| LCW0404_043_GFP-N_C10.ab1 | GSSPSASTGTGPGSST PSGATGSPGSSTPSGA TGSP | 519 | GGTTCTAGCCCTTCTGCTTCCACCGGTACTGG CCCAGGTAGCTCTACCCCTTCTGGTGCTACC GGCTCCCCAGGTAGCTCTACTCCTTCTGGTG CAACTGGCTCTCCA | 563 |
| LCW0404_045_GFP-N_D10.ab1 | GASPGTSSTGSPGSSP SASTGTGPGSSPSAST GTGP | 520 | GGTGCTTCTCCTGGCACCAGCTCTACTGGTTC TCCAGGTTCTAGCCCTTCTGCTTCTACCGGTA CTGGTCCAGGTTCTAGCCCTTCTGCATCCACT GGTACTGGTCCA | 564 |
| LCW0404_047_GFP-N_F10.ab1 | GTPGSGTASSSPGASP GTSSTGSPGASPGTSS TGSP | 521 | GGTACTCCTGGCAGCGGTACCGCTTCTTCTTC TCCAGGTGCTTCTCCTGGTACTAGCTCTACTG GTTCTCCAGGTGCTTCTCCGGGCACTAGCTCT ACTGGTTCTCCA | 565 |
| LCW0404_048_GFP-N_G10.ab1 | GSSTPSGATGSPGASP GTSSTGSPGSSTPSGA TGSP | 522 | GGTAGCTCTACCCCGTCTGGTGCTACCGGTT CCCCAGGTGCTTCTCCTGGTACTAGCTCTACC GGTTCTCCAGGTAGCTCTACCCCGTCTGGTG CTACTGGCTCTCCA | 566 |
| LCW0404_049_GFP-N_H10.ab1 | GSSTPSGATGSPGTPG SGTASSSPGSSTPSGA TGSP | 523 | GGTAGCTCTACCCCGTCTGGTGCTACTGGTT CTCCAGGTACTCCGGGCAGCGGTACTGCTTC TTCCTCTCCAGGTAGCTCTACCCCTTCTGGTG CTACTGGCTCTCCA | 567 |
| LCW0404_050_GFP-N_A11.ab1 | GASPGTSSTGSPGSSP SASTGTGPGSSTPSGA TGSP | 524 | GGTGCATCTCCTGGTACCAGCTCTACTGGTT CTCCAGGTTCTAGCCCTTCTGCTTCTACCGGT ACCGGTCCAGGTAGCTCTACTCCTTCTGGTG CTACCGGTTCTCCA | 568 |
| LCW0404_051_GFP-N_B11.ab1 | GSSTPSGATGSPGSST PSGATGSPGSSTPSGA TGSP | 525 | GGTAGCTCTACCCCGTCTGGTGCTACTGGCT CTCCAGGTAGCTCTACTCCTTCTGGTGCTACT GGTTCCCCAGGTAGCTCTACCCCGTCTGGTG CAACTGGCTCTCCA | 569 |

TABLE 14-continued

DNA and Amino Acid Sequences for 36-mer motifs

| File name | Amino acid sequence | SEQ ID NO: | Nucleotide sequence | SEQ ID NO: |
|---|---|---|---|---|
| LCW0404_052_GFP-N_C11.ab1 | GASPGTSSTGSPGTPGSGTASSSPGASPGTSSTGSP | 526 | GGTGCATCCCCGGGTACCAGCTCTACCGGTTCTCCAGGTACTCCTGGCAGCGGTACTGCATCTTCCTCTCCAGGTGCTTCTCCGGGCACCAGCTCTACTGGTTCTCCA | 570 |
| LCW0404_053_GFP-N_D11.ab1 | GSSTPSGATGSPGSSPSASTGTGPGASPGTSSTGSP | 527 | GGTAGCTCTACTCCTTCTGGTGCAACTGGTTCTCCAGGTTCTAGCCCGTCTGCATCCACTGGTACCGGTCCAGGTGCTTCCCCTGGCACCAGCTCTACCGGTTCTCCA | 571 |
| LCW0404_057_GFP-N_E11.ab1 | GASPGTSSTGSPGSSTPSGATGSPGSSPSASTGTGP | 528 | GGTGCATCTCCTGGTACTAGCTCTACTGGTTCTCCAGGTAGCTCTACTCCGTCTGGTGCAACCGGCTCTCCAGGTTCTAGCCCTTCTGCATCTACCGGTACTGGTCCA | 572 |
| LCW0404_060_GFP-N_F11.ab1 | GTPGSGTASSSPGSSTPSGATGSPGASPGTSSTGSP | 529 | GGTACTCCTGGCAGCGGTACCGCATCTTCCTCTCCAGGTAGCTCTACTCCGTCTGGTGCAACTGGTTCCCCAGGTGCTTCTCCGGGTACCAGCTCTACCGGTTCTCCA | 573 |
| LCW0404_062_GFP-N_G11.ab1 | GSSTPSGATGSPGTPGSGTASSSPGSSTPSGATGSP | 530 | GGTAGCTCTACCCCGTCTGGTGCAACCGGCTCCCCAGGTACTCCTGGTAGCGGTACCGCTTCTTCTTCTCCAGGTAGCTCTACTCCGTCTGGTGCTACCGGCTCCCCA | 574 |
| LCW0404_066_GFP-N_H11.ab1 | GSSPSASTGTGPGSSPSASTGTGPGASPGTSSTGSP | 531 | GGTTCTAGCCCTTCTGCATCCACCGGTACCGGCCCAGGTTCTAGCCCGTCTGCTTCTACCGGTACTGGTCCAGGTGCTTCTCCGGGTACTAGCTCTACTGGTTCTCCA | 575 |
| LCW0404_067_GFP-N_A12.ab1 | GTPGSGTASSSPGSSTPSGATGSPGSNPSASTGTGP | 532 | GGTACCCCGGGTAGCGGTACCGCTTCTTCTTCTCCAGGTAGCTCTACTCCGTCTGGTGCTACCGGCTCTCCAGGTTCTAACCCTTCTGCATCCACCGGTACCGGCCCA | 576 |
| LCW0404_068_GFP-N_B12.ab1 | GSSPSASTGTGPGSSTPSGATGSPGASPGTSSTGSP | 533 | GGTTCTAGCCCTTCTGCATCTACTGGTACTGGCCCAGGTAGCTCTACTCCTTCTGGTGCTACCGGCTCTCCAGGTGCTTCTCCGGGTACTAGCTCTACCGGTTCTCCA | 577 |
| LCW0404_069_GFP-N_C12.ab1 | GSSTPSGATGSPGASPGTSSTGSPGTPGSGTASSSP | 534 | GGTAGCTCTACCCCTTCTGGTGCAACCGGCTCTCCAGGTGCATCCCCGGGTACCAGCTCTACCGGTTCTCCAGGTACTCCGGGTAGCGGTACCGCTTCTTCCTCTCCA | 578 |
| LCW0404_070_GFP-N_D12.ab1 | GSSTPSGATGSPGSSTPSGATGSPGSSTPSGATGSP | 535 | GGTAGCTCTACTCCGTCTGGTGCAACCGGTTCCCCAGGTAGCTCTACCCCTTCTGGTGCAACCGGCTCCCCAGGTAGCTCTACCCCTTCTGGTGCAACTGGCTCTCCA | 579 |
| LCW0404_073_GFP-N_E12.ab1 | GASPGTSSTGSPGTPGSGTASSSPGSSTPSGATGSP | 536 | GGTGCTTCTCCTGGCACTAGCTCTACCGGTTCTCCAGGTACCCCTGGTAGCGGTACCGCATCTTCCTCTCCAGGTAGCTCTACTCCTTCTGGTGCTACTGGTTCCCCA | 580 |
| LCW0404_075_GFP-N_F12.ab1 | GSSTPSGATGSPGSSPSASTGTGPGSSPSASTGTGP | 537 | GGTAGCTCTACCCCGTCTGGTGCTACTGGCTCCCCAGGTTCTAGCCCTTCTGCATCCACCGGTACCGGTCCAGGTTCTAGCCCGTCTGCATCTACTGGTACTGGTCCA | 581 |
| LCW0404_080_GFP-N_G12.ab1 | GASPGTSSTGSPGSSPSASTGTGPGSSPSASTGTGP | 538 | GGTGCTTCCCCGGGCACCAGCTCTACTGGTTCTCCAGGTTCTAGCCCGTCTGCTTCTACTGGTACTGGTCCAGGTTCTAGCCCTTCTGCTTCCACTGGTACTGGTCCA | 582 |
| LCW0404_081_GFP-N_H12.ab1 | GASPGTSSTGSPGSSPSASTGTGPGTPGSGTASSSP | 539 | GGTGCTTCCCCGGGTACCAGCTCTACCGGTTCTCCAGGTTCTAGCCCTTCTGCTTCTACCGGTACCGGTCCAGGTACCCCTGGCAGCGGTACCGCATCTTCCTCTCCA | 583 |

Example 5

Construction of XTEN_AE864

XTEN_AE864 was constructed from serial dimerization of XTEN_AE36 to AE72, 144, 288, 576 and 864. A collection of XTEN_AE72 segments was constructed from 37 different segments of XTEN_AE36. Cultures of *E. coli* harboring all 37 different 36-amino acid segments were mixed and plasmid was isolated. This plasmid pool was digested with BsaI/NcoI to generate the small fragment as the insert. The same plasmid pool was digested with BbsI/NcoI to generate the large fragment as the vector. The insert and vector fragments were ligated resulting in a doubling of the length and the ligation mixture was transformed into BL21Gold(DE3) cells to obtain colonies of XTEN_AE72.

This library of XTEN_AE72 segments was designated LCW0406. All clones from LCW0406 were combined and dimerized again using the same process as described above yielding library LCW0410 of XTEN_AE144. All clones from LCW0410 were combined and dimerized again using the same process as described above yielding library LCW0414 of XTEN_AE288. Two isolates LCW0414.001 and LCW0414.002 were randomly picked from the library and sequenced to verify the identities. All clones from LCW0414 were combined and dimerized again using the same process as described above yielding library LCW0418 of XTEN_AE576. We screened 96 isolates from library LCW0418 for high level of GFP fluorescence. 8 isolates with right sizes of inserts by PCR and strong fluorescence were sequenced and 2 isolates (LCW0418.018 and LCW0418.052) were chosen for future use based on sequencing and expression data.

The specific clone pCW0432 of XTEN_AE864 was constructed by combining LCW0418.018 of XTEN_AE576 and LCW0414.002 of XTEN_AE288 using the same dimerization process as described above.

Example 6

Construction of XTEN_AM144

A collection of XTEN_AM144 segments was constructed starting from 37 different segments of XTEN_AE36, 44 segments of XTEN_AF36, and 44 segments of XTEN_AG36.

Cultures of *E. coli* that harboring all 125 different 36-amino acid segments were mixed and plasmid was isolated. This plasmid pool was digested with BsaI/NcoI to generate the small fragment as the insert. The same plasmid pool was digested with BbsI/NcoI to generate the large fragment as the vector. The insert and vector fragments were ligated resulting in a doubling of the length and the ligation mixture was transformed into BL21Gold(DE3) cells to obtain colonies of XTEN_AM72.

This library of XTEN_AM72 segments was designated LCW0461. All clones from LCW0461 were combined and dimerized again using the same process as described above yielding library LCW0462. 1512 Isolates from library LCW0462 were screened for protein expression. Individual colonies were transferred into 96 well plates and cultured overnight as starter cultures. These starter cultures were diluted into fresh autoinduction medium and cultured for 20-30 h. Expression was measured using a fluorescence plate reader with excitation at 395 nm and emission at 510 nm 192 isolates showed high level expression and were submitted to DNA sequencing. Most clones in library LCW0462 showed good expression and similar physicochemical properties suggesting that most combinations of XTEN_AM36 segments yield useful XTEN sequences. 30 isolates from LCW0462 were chosen as a preferred collection of XTEN_AM144 segments for the construction of multifunctional proteins that contain multiple XTEN segments. The file names of the nucleotide and amino acid constructs and the sequences for these segments are listed in Table 15.

TABLE 15

DNA and amino acid sequences for AM144 segments

| Clone | Sequence Trimmed | SEQ ID NO: | Protein Sequence | SEQ ID NO: |
|---|---|---|---|---|
| LCW462_r1 | GGTACCCCGGGCAGCGGTACCGCATCTTCCTCTCCAG<br>GTAGCTCTACCCCGTCTGGTGCTACCGGTTCCCCAGG<br>TAGCTCTACCCCGTCTGGTGCAACCGGCTCCCCAGGT<br>AGCCCGGCTGGCTCTCCTACCTCTACTGAGGAAGGTA<br>CTTCTGAAAGCGCTACTCCTGAGTCTGGTCCAGGTAC<br>CTCTACTGAACCGTCCGAAGGTAGCGCTCCAGGTTCT<br>AGCCCTTCTGCATCCACCGGTACCGGCCCAGGTTCTA<br>GCCCGTCTGCTTCTACCGGTACTGGTCCAGGTGCTTCT<br>CCGGGTACTAGCTCTACTGGTTCTCCAGGTACCTCTA<br>CCGAACCGTCCGAGGGTAGCGCACCAGGTACCTCTAC<br>TGAACCGTCTGAGGGTAGCGCTCCAGGTAGCGAACC<br>GGCAACCTCCGGTTCTGAAACTCCA | 584 | GTPGSGTASSSPG<br>SSTPSGATGSPGS<br>STPSGATGSPGSP<br>AGSPTSTEEGTSE<br>SATPESGPGTSTE<br>PSEGSAPGSSPSA<br>STGTGPGSSPSAS<br>TGTGPGASPGTSS<br>TGSPGTSTEPSEG<br>SAPGTSTEPSEGS<br>APGSEPATSGSET<br>P | 617 |
| LCW462_r5 | GGTTCTACCAGCGAATCCCCTTCTGGCACTGCACCAG<br>GTTCTACTAGCGAATCCCCTTCTGGTACCGCACCAGG<br>TACTTCTCCGAGCGGCGAATCTTCTACTGCTCCAGGT<br>ACCTCTACTGAACCTTCCGAAGGCAGCGCTCCAGGTA<br>CCTCTACCGAACCGTCCGAGGGCAGCGCACCAGGTAC<br>TTCTGAAAGCGCAACCCCTGAATCCGGTCCAGGTGCA<br>TCTCCTGGTACCAGCTCTACCGGTTCTCCAGGTAGCTC<br>TACTCCTTCTGGTGCTACTGGCTCTCCAGGTGCTTCCC<br>CGGGTACCAGCTCTACCGGTTCTCCAGGTTCTACTAG<br>CGAATCTCCTTCTGGCACTGCACCAGGTTCTACCAGC<br>GAATCTCCGTCTGGCACTGCACCAGGTACCTCTACCC<br>CTGAAAGCGGTTCCGCTTCTCCA | 585 | GSTSESPSGTAPG<br>STSESPSGTAPGT<br>SPSGESSTAPGTS<br>TEPSEGSAPGTST<br>EPSEGSAPGTSES<br>ATPESGPGASPGT<br>SSTGSPGSSTPSG<br>ATGSPGASPGTSS<br>TGSPGSTSESPSG<br>TAPGSTSESPSGT<br>APGTSTPESGSAS<br>P | 618 |

TABLE 15-continued

DNA and amino acid sequences for AM144 segments

| Clone | Sequence Trimmed | SEQ ID NO: | Protein Sequence | SEQ ID NO: |
|---|---|---|---|---|
| LCW462_r9 | GGTACTTCTACCGAACCTTCCGAGGGCAGCGCACCAG GTACTTCTGAAAGCGCTACCCCTGAGTCCGGCCCAGG TACTTCTGAAAGCGCTACTCCTGAATCCGGTCCAGGT ACCTCTACTGAACCTTCTGAGGGCAGCGCTCCAGGTA CTTCTGAAAGCGCTACCCCGGAGTCCGGTCCAGGTAC TTCTACTGAACCTCCGAAGGTAGCGCACCAGGTACT TCTACTGAACCTTCCGAAGGTAGCGCTCCAGGTAGCG AACCTGCTACTTCTGGTTCTGAAACCCCAGGTAGCCC GGCTGGCTCTCCGACCTCCACCGAGGAAGGTGCTTCT CCTGGCACCAGCTCTACTGGTTCTCCAGGTTCTAGCC CTTCTGCTTCTACCGGTACTGGTCCAGGTTCTAGCCCT TCTGCATCCACTGGTACTGGTCCA | 586 | GTSTEPSEGSAPG TSESATPESGPGT SESATPESGPGTS TEPSEGSAPGTSE SATPESGPGTSTE PSEGSAPGTSTEP SEGSAPGSEPATS GSETPGSPAGSPT STEEGASPGTSST GSPGSSPSASTGT GPGSSPSASTGTG P | 619 |
| LCW462_r10 | GGTAGCGAACCGGCAACCTCTGGCTCTGAAACCCCAG GTACCTCTGAAAGCGCTACTCCGGAATCTGGTCCAGG TACTTCTGAAAGCGCTACTCCGGAATCCGGTCCAGGT TCTACCAGCGAATCTCCTTCTGGCACCGCTCCAGGTT CTACTAGCGAATCCCCGTCTGGTACCGCACCAGGTAC TTCTCCTAGCGGCGAATCTTCTACCGCACCAGGTGCA TCTCCGGGTACTAGCTCTACCGGTTCTCCAGGTTCTAG CCCTTCTGCTTCCACTGGTACCGGCCCAGGTAGCTCT ACCCCGTCTGGTGCTACTGGTTCCCAGGTAGCTCTA CTCCGTCTGGTGCAACCGGTTCCCAGGTAGCTCTAC TCCTTCTGGTGCTACTGGCTCCCCAGGTGCATCCCTG GCACCAGCTCTACCGGTTCTCCA | 587 | GSEPATSGSETPG TSESATPESGPGT SESATPESGPGST SESPSGTAPGSTS ESPSGTAPGTSPS GESSTAPGASPGT SSTGSPGSSPSAS TGTGPGSSTPSGA TGSPGSSTPSGAT GSPGSSTPSGATG SPGASPGTSSTGS P | 620 |
| LCW462_r15 | GGTGCTTCTCCGGGCACCAGCTCTACTGGTTCTCCAG GTTCTAGCCCTTCTGCATCCACCGGTACCGGTCCAGG TAGCTCTACCCCTTCTGGTGCAACCGGCTCTCCAGGT ACTTCTGAAAGCGCTACCCCGGAATCTGGCCCAGGTA GCGAACCGGCTACTTCTGGTTCTGAAACCCCAGGTAG CGAACCGGCTACTTCCGGTTCTGAAACTCCAGGTACT TCTGAAAGCGCTACTCCGGAGTCCGGTCCAGGTACCT CTACCGAACCGTCCGAAGGCAGCGCTCCAGGTACTTC TACTGAACCTTCTGAGGGTAGCGCTCCAGGTACCTCT ACCGAACCGTCCGAGGGTAGCGCACCAGGTACCTCTA CTGAACCGTCTGAGGGTAGCGCTCCAGGTAGCGAACC GGCAACCTCCGGTTCTGAAACTCCA | 588 | GASPGTSSTGSPG SSPSASTGTGPGS STPSGATGSPGTS ESATPESGPGSEP ATSGSETPGSEPA TSGSETPGTSESA TPESGPGTSTEPS EGSAPGTSTEPSE GSAPGTSTEPSEG SAPGTSTEPSEGS APGSEPATSGSET P | 621 |
| LCW462_r16 | GGTACCTCTACCGAACCTTCCGAAGGTAGCGCTCCAG GTAGCCCGGCAGGTTCTCCTACTTCCACTGAGGAAGG TACTTCTACCGAACCTTCTGAGGGTAGCGCACCAGGT ACCTCTGAAAGCGCAACTCCTGAGTCTGGCCCAGGTA GCGAACCTGCTACCTCCGGCTCTGAGACTCCAGGTAC CTCTGAAAGCGCAACCCCGGAATCTGGTCCAGGTAGC CCGGCTGGCTCTCCTACCTCTACTGAGGAAGGTACTT CTGAAAGCGCTACTCCTGAGTCTGGTCCAGGTACCTC TACTGAACCGTCCGAAGGTAGCGCTCCAGGTAGCGA ACCTGCTACTTCTGGTTCTGAAACTCCAGGTACTTCTA CCGAACCGTCCGAGGGTAGCGCTCCAGGTAGCGAAC CTGCTACTTCTGGTTCTGAAACTCCA | 589 | GTSTEPSEGSAPG SPAGSPTSTEEGT STEPSEGSAPGTS ESATPESGPGSEP ATSGSETPGTSES ATPESGPGSPAGS PTSTEEGTSESAT PESGPGTSTEPSE GSAPGSEPATSGS ETPGTSTEPSEGS APGSEPATSGSET P | 622 |
| LCW462_r20 | GGTACTTCTACCGAACCGTCCGAAGGCAGCGCTCCAG GTACCTCTACTGAACCTTCCGAGGGCAGCGCTCCAGG TACCTCTACCGAACCTTCTGAAGGTAGCGCACCAGGT ACTTCTACCGAACCGTCCGAAGGCAGCGCTCCAGGTA CCTCTACTGAACCTTCCGAGGGCAGCGCTCCAGGTAC CTCTACCGAACCTTCTGAAGGTAGCGCACCAGGTACT TCTACCGAACCTTCCGAGGGCAGCGCACCAGGTACTT CTGAAAGCGCTACCCCTGAGTCCGGCCCAGGTACTTC TGAAAGCGCTACTCCTGAATCCGGTCCAGGTACTTCT ACTGAACCTTCCGAAGGTAGCGCTCCAGGTAGCGAAC CTGCTACTTCTGGTTCTGAAACCCCAGGTAGCCCGGC TGGCTCTCCGACCTCCACCGAGGAA | 590 | GTSTEPSEGSAPG TSTEPSEGSAPGT STEPSEGSAPGTS TEPSEGSAPGTST EPSEGSAPGTSTE PSEGSAPGTSTEP SEGSAPGTSESAT PESGPGTSESATP ESGPGTSTEPSEG SAPGSEPATSGSE TPGSPAGSPTSTE E | 623 |
| LCW462_r23 | GGTACTTCTACCGAACCGTCCGAGGGCAGCGCTCCAG GTACTTCTACTGAACCTTCTGAAGGCAGCGCTCCAGG TACTTCTACTGAACCTTCCGAAGGTAGCGCACCAGGT TCTACCAGCGAATCCCCTTCTGGTACTGCTCCAGGTTC TACCAGCGAATCCCCTTCTGGCACCGCACCAGGTACT TCTACCCCTGAAAGCGGCTCCGCTTCTCCAGGTAGCG AACCTGCAACCTCTGGCTCTGAAACCCCAGGTACCTC TGAAAGCGCTACTCCTGAATCTGGCCCAGGTACTTCT | 591 | GTSTEPSEGSAPG TSTEPSEGSAPGT STEPSEGSAPGST SESPSGTAPGSTS ESPSGTAPGTSTP ESGSASPGSEPAT SGSETPGTSESAT PESGPGTSTEPSE | 624 |

TABLE 15-continued

DNA and amino acid sequences for AM144 segments

| Clone | Sequence Trimmed | SEQ ID NO: | Protein Sequence | SEQ ID NO: |
|---|---|---|---|---|
| | ACTGAACCGTCCGAGGGCAGCGCACCAGGTACTTCTA CTGAACCGTCTGAAGGTAGCGCACCAGGTACTTCTGA AAGCGCAACCCCGGAATCCGGCCCAGGTACCTCTGA AAGCGCAACCCCGGAGTCCGGCCCA | | GSAPGTSTEPSEG SAPGTSESATPES GPGTSESATPESG P | |
| LCW462_r24 | GGTAGCTCTACCCCTTCTGGTGCTACCGGCTCTCCAG GTTCTAGCCCGTCTGCTTCTACCGGTACCGGTCCAGG TAGCTCTACCCCTTCTGGTGCTACTGGTTCTCCAGGTA GCCCTGCTGGCTCTCCGACTTCTACTGAGGAAGGTAG CCCCGGCTGGTTCTCCGACTTCTACTGAGGAAGGTACT TCTACCGAACCTTCCGAAGGTAGCGCTCCAGGTGCTT CCCCGGGCACTAGCTCTACCGGTTCTCCAGGTTCTAG CCCTTCTGCATCTACTGGTACTGGCCCAGGTACTCCG GGCAGCGGTACTGCTTCTTCCTCTCCAGGTTCTACTAG CTCTACTGCTGAATCTCCTGGCCCAGGTACTTCTCCTA GCGGTGAATCTTCTACCGCTCCAGGTACCTCTACTCC GGAAAGCGGTTCTGCATCTCCA | 592 | GSSTPSGATGSPG SSPSASTGTGPGS STPSGATGSPGSP AGSPTSTEEGSPA GSPTSTEEGTSTE PSEGSAPGASPGT SSTGSPGSSPSAS TGTGPGTPGSGT ASSSPGSTSSTAE SPGPGTSPSGESS TAPGTSTPESGSA SP | 625 |
| LCW462_r27 | GGTACCTCTACTGAACCTTCTGAGGGCAGCGCTCCAG GTACTTCTGAAAGCGCTACCCCGGAGTCCGGTCCAGG TACTTCTACTGAACCGTCCGAAGGTAGCGCACCAGGT ACTTCTACTGAACCGTCTGAAGGTAGCGCACCAGGTA CTTCTGAAAGCGCAACCCCGGAATCCGGCCCAGGTAC CTCTGAAAGCGCAACCCCGGAGTCCGGCCCAGGTACT CCTGGCAGCGGTACCGCTTCTTCTTCTCCAGGTGCTTC TCCTGGTACTAGCTCTACTGGTTCTCCAGGTGCTTCTC CGGGCACTAGCTCTACTGGTTCTCCAGGTAGCCCTGC TGGCTCTCCGACTTCTACTGAGGAAGGTAGCCCGGCT GGTTCTCCGACTTCTACTGAGGAAGGTACTTCTACCG AACCTTCCGAAGGTAGCGCTCCA | 593 | GTSTEPSEGSAPG TSESATPESGPGT STEPSEGSAPGTS TEPSEGSAPGTSE SATPESGPGTSES ATPESGPGTPGSG TASSSPGASPGTS STGSPGASPGTSS TGSPGSPAGSPTS TEEGSPAGSPTST EEGTSTEPSEGSA P | 626 |
| LCW462_r28 | GGTAGCCCAGCAGGCTCTCCGACTTCCACTGAGGAAG GTACTTCTACTGAACCTTCCGAAGGCAGCGCACCAGG TACCTCTACTGAACCTTCTGAGGGCAGCGCTCCAGGT ACCTCTACCGAACCGTCTGAAGGTAGCGCACCAGGTA CCTCTGAAAGCGCAACTCCTGAGTCCGGTCCAGGTAC TTCTGAAAGCGCAACCCCGGAGTCTGGCCCAGGTACC CCGGGTAGCGGTACTGCTTCTTCCTCTCCAGGTAGCT CTACCCCTTCTGGTGCAACCGGCTCTCCAGGTGCTTCT CCGGGCACCAGCTCTACCGGTTCTCCAGGTACCTCTA CTGAACCTTCTGAGGGCAGCGCTCCAGGTACTTCTGA AAGCGCTACCCCGGAGTCCGGTCCAGGTACTTCTACT GAACCGTCCGAAGGTAGCGCACCA | 594 | GSPAGSPTSTEEG TSTEPSEGSAPGT STEPSEGSAPGTS TEPSEGSAPGTSE SATPESGPGTSES ATPESGPGTPGSG TASSSPGSSTPSG ATGSPGASPGTSS TGSPGTSTEPSEG SAPGTSESATPES GPGTSTEPSEGSA P | 627 |
| LCW462_r38 | GGTAGCGAACCGGCAACCTCCGGCTCTGAAACTCCAG GTACTTCTGAAAGCGCTACTCCGGAATCCGGCCCAGG TAGCGAACCGGCTACTTCCGGCTCTGAAACCCCAGGT AGCTCTACCCCGTCTGGTGCAACCGGCTCCCCAGGTA CTCCTGGTAGCGGTACCGCTTCTTCTTCTCCAGGTAGC TCTACTCCGTCTGGTGCTACCGGCTCCCCAGGTGCAT CTCCTGGTACCAGCTCTACCGGTTCTCCAGGTAGCTCT ACTCCTTCTGGTGCTACTGGCTCTCCAGGTGCTTCCCC GGGTACCAGCTCTACCGGTTCTCCAGGTAGCGAACCT GCTACTTCTGGTTCTGAAACTCCAGGTACTTCTACCG AACCGTCCGAGGGTAGCGCTCCAGGTAGCGAACCTG CTACTTCTGGTTCTGAAACTCCA | 595 | GSEPATSGSETPG TSESATPESGPGS EPATSGSETPGSS TPSGATGSPGTPG SGTASSSPGSSTP SGATGSPGASPGT SSTGSPGSSTPSG ATGSPGASPGTSS TGSPGSEPATSGS ETPGTSTEPSEGS APGSEPATSGSET P | 628 |
| LCW462_r39 | GGTACCTCTACTGAACCTTCCGAAGGCAGCGCTCCAG GTACCTCTACCGAACCGTCCGAGGGCAGCGCACCAG GTACTTCTGAAAGCGCAACCCCTGAATCCGGTCCAGG TAGCCCTGCTGGCTCTCCGACTTCTACTGAGGAAGGT AGCCCGGCTGGTTCTCCGACTTCTACTGAGGAAGGTA CTTCTACCGAACCTTCCGAAGGTAGCGCTCCAGGTAG CCCGGCTGGTTCTCCGACTTCCACCGAGGAAGGTACC TCTACTGAACCTTCTGAGGGTAGCGCTCCAGGTACCT CTACTGAACCTTCCGAAGGCAGCGCTCCAGGTGCTTC CCCGGGCACCAGCTCTACTGGTTCTCCAGGTTCTAGC CCGTCTGCTTCTACTGGTACTGGTCCAGGTTCTAGCCC TTCTGCTTCCACTGGTACTGGTCCA | 596 | GTSTEPSEGSAPG TSTEPSEGSAPGT SESATPESGPGSP AGSPTSTEEGSPA GSPTSTEEGTSTE PSEGSAPGSPAGS PTSTEEGTSTEPS EGSAPGTSTEPSE GSAPGASPGTSST GSPGSSPSASTGT GPGSSPSASTGTG P | 629 |
| LCW462_r41 | GGTAGCTCTACCCCGTCTGGTGCTACCGGTTCCCCAG GTGCTTCTCCTGGTACTAGCTCTACCGGTTCTCCAGGT AGCTCTACCCCGTCTGGTGCTACTGGCTCTCCAGGTA GCCCTGCTGGCTCTCCAACCTCCACCGAAGAAGGTAC | 597 | GSSTPSGATGSPG ASPGTSSTGSPGS STPSGATGSPGSP AGSPTSTEEGTSE | 630 |

TABLE 15-continued

DNA and amino acid sequences for AM144 segments

| Clone | Sequence Trimmed | SEQ ID NO: | Protein Sequence | SEQ ID NO: |
|---|---|---|---|---|
| | CTCTGAAAGCGCAACCCCTGAATCCGGCCCAGGTAGC GAACCGGCAACCTCCGGTTCTGAAACCCCAGGTGCAT CTCCTGGTACTAGCTCTACTGGTTCTCCAGGTAGCTCT ACTCCGTCTGGTGCAACCGGCTCTCCAGGTTCTAGCC CTTCTGCATCTACCGGTACTGGTCCAGGTTCTACCAG CGAATCCCCTTCTGGTACTGCTCCAGGTTCTACCAGC GAATCCCCTTCTGGCACCGCACCAGGTACTTCTACCC CTGAAAGCGGCTCCGCTTCTCCA | | SATPESGPGSEPA TSGSETPGASPGT SSTGSPGSSTPSG ATGSPGSSPSAST GTGPGSTSESPSG TAPGSTSESPSGT APGTSTPESGSAS P | |
| LCW462_r42 | GGTTCTACCAGCGAATCTCCTTCTGGCACCGCTCCAG GTTCTACTAGCGAATCCCCGTCTGGTACCGCACCAGG TACTTCTCCTAGCGGCGAATCTTCTACCGCACCAGGT ACCTCTGAAAGCGCTACTCCGGAGTCTGGCCCAGGTA CCTCTACTGAACCGTCTGAGGGTAGCGCTCCAGGTAC TTCTACTGAACCGTCCGAAGGTAGCGCACCAGGTACC TCTACTGAACCTTCTGAGGGCAGCGCTCCAGGTACTT CTGAAAGCGCTACCCCGGAGTCCGGTCAGGTACTTC TACTGAACCGTCCGAAGGTAGCGCACCAGGTAGCTCT ACCCCGTCTGGTGCTACCGGTTCCCAGGTGCTTCTCC TGGTACTAGCTCTACCGGTTCTCCAGGTAGCTCTACC CCGTCTGGTGCTACTGGCTCTCCA | 598 | GSTSESPSGTAPG STSESPSGTAPGT SPSGESSTAPGTS ESATPESGPGTST EPSEGSAPGTSTE PSEGSAPGTSTEP SEGSAPGTSESAT PESGPGTSTEPSE GSAPGSSTPSGAT GSPGASPGTSSTG SPGSSTPSGATGS P | 631 |
| LCW462_r43 | GGTTCTACTAGCTCTACTGCAGAATCTCCGGGCCCAG GTACCTCTCCTAGCGGTGAATCTTCTACCGCTCCAGG TACTTCTCCGAGCGGTGAATCTTCTACCGCTCCAGGTT CTACTAGCTCTACCGCTGAATCTCCGGGTCCAGGTTC TACCAGCTCTACTGCAGAATCTCCTGGCCCAGGTACT TCTACTCCGGAAAGCGGTTCCGCTTCTCCAGGTACTT CTCCTAGCGGTGAATCTTCTACCGCTCCAGGTTCTACC AGCTCTACTGCTGAATCTCCTGGCCCAGGTACTTCTA CCCCGGAAAGCGGCTCCGCTTCTCCAGGTTCTACCAG CTCTACCGCTGAATCTCCTGGCCCAGGTTCTACTAGC GAATCTCCGTCTGGCACCGCACCAGGTACTTCCCCTA GCGGTGAATCTTCTACTGCACCA | 599 | GSTSSTAESPGPG TSPSGESSTAPGT SPSGESSTAPGST SSTAESPGPGSTS STAESPGPGTSTP ESGSASPGTSPSG ESSTAPGSTSSTA ESPGPGTSTPESG SASPGSTSSTAES PGPGSTSESPSGT APGTSPSGESSTA P | 632 |
| LCW462_r45 | GGTACCTCTACTCCGGAAAGCGGTTCCGCATCTCCAG GTTCTACCAGCGAATCCCCGTCTGGCACCGCACCAGG TTCTACTAGCTCTACTGCTGAATCTCCGGGCCCAGGT ACCTCTACTGAACCTTCCGAAGGCAGCGCTCCAGGTA CCTCTACCGAACCGTCCGAGGGCAGCGCACCAGGTAC TTCTGAAAGCGCAACCCCTGAATCCGGTCCAGGTACC TCTGAAAGCGCTACTCCGGAGTCTGGCCCAGGTACCT CTACTGAACCGTCTGAGGGTAGCGCTCCAGGTACTTC TACTGAACCGTCCGAAGGTAGCGCACCAGGTACTTCT GAAAGCGCTACTCCGGAGTCCGGTCCAGGTACCTCTA CCGAACCGTCCGAAGGCAGCGCTCCAGGTACTTCTAC TGAACCTTCTGAGGGTAGCGCTCCC | 600 | GTSTPESGSASPG STSESPSGTAPGS TSSTAESPGPGTS TEPSEGSAPGTST EPSEGSAPGTSES ATPESGPGTSESA TPESGPGTSTEPS EGSAPGTSTEPSE GSAPGTSESATPE SGPGTSTEPSEGS APGTSTEPSEGSA P | 633 |
| LCW462_r47 | GGTACCTCTACCGAACCGTCCGAGGGTAGCGCACCAG GTACCTCTACTGAACCGTCTGAGGGTAGCGCTCCAGG TAGCGAACCGGCAACCTCCGGTTCTGAAACTCCAGGT ACTTCTACTGAACCGTCTGAAGGTAGCGCACCAGGTA CTTCTGAAAGCGCAACCCCGGAATCCGGCCCAGGTAC CTCTGAAAGCGCAACCCCGGAGTCCGGCCCAGGTGC ATCTCCGGGTACTAGCTCTACCGGTTCTCCAGGTTCTA GCCCTTCTGCTTCCACTGGTACCGGCCCAGGTAGCTC TACCCCGTCTGGTGCTACTGGTTCCCCAGGTAGCTCT ACTCCGTCTGGTGCAACCGGTTCCCAGGTAGCTCTA CTCCTTCTGGTGCTACTGGCTCCCAGGTGCATCCCCT GGCACCAGCTCTACCGGTTCTCCA | 601 | GTSTEPSEGSAPG TSTEPSEGSAPGS EPATSGSETPGTS TEPSEGSAPGTSE SATPESGPGTSES ATPESGPGASPGT SSTGSPGSSPSAS TGTGPGSSTPSGA TGSPGSSTPSGAT GSPGSSTPSGATG SPGASPGTSSTGS P | 634 |
| LCW462_r54 | GGTAGCGAACCGGCAACCTCTGGCTCTGAAACTCCAG GTAGCGAACCTGCAACCTCCGGCTCTGAAACCCCAGG TACTTCTACTGAACCTTCTGAGGGCAGCGCACCAGGT AGCGAACCTGCAACCTCTGGCTCTGAAACCCCAGGTA CCTCTGAAAGCGCTACTCCTGAATCTGGCCCAGGTAC TTCTACTGAACCGTCCGAGGGCAGCGCACCAGGTAGC TCTACTCCGTCTGGTGCTACCGGCTCTCCAGGTAGCTC TACCCCTTCTGGTGCAACCGGTTCCCCAGGTGCTTCTC CGGGTACCAGCTCTACTGGTTCTCCAGGTAGCTCTAC CCCGTCTGGTGCTACCGGTTCCCAGGTGCTTCTCCTG GTACTAGCTCTACCGGTTCTCCAGGTAGCTCTACCCC GTCTGGTGCTACTGGCTCTCCA | 602 | GSEPATSGSETPG SEPATSGSETPGT STEPSEGSAPGSE PATSGSETPGTSE SATPESGPGTSTE PSEGSAPGSSTPS GATGSPGSSTPSG ATGSPGASPGTSS TGSPGSSTPSGAT GSPGASPGTSSTG SPGSSTPSGATGS P | 635 |

TABLE 15-continued

DNA and amino acid sequences for AM144 segments

| Clone | Sequence Trimmed | SEQ ID NO: | Protein Sequence | SEQ ID NO: |
|---|---|---|---|---|
| LCW462_r55 | GGTACTTCTACCGAACCGTCCGAGGGCAGCGCTCCAG<br>GTACTTCTACTGAACCTTCTGAAGGCAGCGCTCCAGG<br>TACTTCTACTGAACCTTCCGAAGGTAGCGCACCAGGT<br>ACTTCTGAAAGCGCTACTCCGGAGTCCGGTCCAGGTA<br>CCTCTACCGAACCGTCCGAAGGCAGCGCTCCAGGTAC<br>TTCTACTGAACCTTCTGAGGGTAGCGCTCCAGGTTCT<br>ACTAGCGAATTCCGTCTGGCACTGCTCCAGGTACTT<br>CTCCTAGCGGTAATCTTCTACCGCTCCAGGTACTTCC<br>CCTAGCGGCGAATCTTCTACCGCTCCAGGTAGCCCGG<br>CTGGCTCTCCTACCTCTACTGAGGAAGGTACTTCTGA<br>AAGCGCTACTCCTGAGTCTGGTCCAGGTACCTCTACT<br>GAACCGTCCGAAGGTAGCGCTCCA | 603 | GTSTEPSEGSAPG<br>TSTEPSEGSAPGT<br>STEPSEGSAPGTS<br>ESATPESGPGTST<br>EPSEGSAPGTSTE<br>PSEGSAPGTSSES<br>PSGTAPGTSPSGE<br>SSTAPGTSPSGES<br>STAPGSPAGSPTS<br>TEEGTSESATPES<br>GPGTSTEPSEGSA<br>P | 636 |
| LCW462_r57 | GGTACTTCTACTGAACCTTCCGAAGGTAGCGCTCCAG<br>GTAGCGAACCTGCTACTTCTGGTTCTGAAACCCCAGG<br>TAGCCCGGCTGGCTCTCCGACCTCCACCGAGGAAGGT<br>AGCCCGGCAGGCTCTCCGACCTCTACTGAGGAAGGTA<br>CTTCTGAAAGCGCAACCCCGGAGTCCGGCCCAGGTAC<br>CTCTACCGAACCGTCTGAGGGCAGCGCACCAGGTACC<br>TCTACTGAACCTTCCGAAGGCAGCGCTCCAGGTACCT<br>CTACCGAACCGTCCGAGGGCAGCGCACCAGGTACTTC<br>TGAAAGCGCAACCCCTGAATCCGGTCCAGGTAGCTCT<br>ACTCCGTCTGGTGCAACCGGCTCCCAGGTTCTAGCC<br>CGTCTGCTTCCACTGGTACTGGCCCAGGTGCTTCCC<br>GGGCACCAGCTCTACTGGTTCTCCA | 604 | GTSTEPSEGSAPG<br>SEPATSGSETPGS<br>PAGSPTSTEEGSP<br>AGSPTSTEEGTSE<br>SATPESGPGTSTE<br>PSEGSAPGTSTEP<br>SEGSAPGTSTEPS<br>EGSAPGTSESATP<br>ESGPGSSTPSGAT<br>GSPGSSPSASTGT<br>GPGASPGTSSTGS<br>P | 637 |
| LCW462_r61 | GGTAGCGAACCGGCTACTTCCGGCTCTGAGACTCCAG<br>GTAGCCCTGCTGGCTCTCCGACCTCTACCGAAGAAGG<br>TACCTCTGAAAGCGCTACCCCTGAGTCTGGCCCAGGT<br>ACCTCTACTGAACCTTCCGAAGGCAGCGCTCCAGGTA<br>CCTCTACCGAACCGTCCGAGGGCAGCGCACCAGGTAC<br>TTCTGAAAGCGCAACCCCTGAATCCGGTCCAGGTACC<br>TCTACTCCGGAAAGCGGTTCCGCATCTCCAGGTTCTA<br>CCAGCGAATCCCCGTCTGGCACCGCACCAGGTTCTAC<br>TAGCTCTACTGCTGAATCTCCGGGCCCAGGTACTTCT<br>GAAAGCGCTACTCCGGAGTCCGGTCCAGGTACCTCTA<br>CCGAACCGTCCGAAGGCAGCGCTCCAGGTACTTCTAC<br>TGAACCTTCTGAGGGTAGCGCTCCA | 605 | GSEPATSGSETPG<br>SPAGSPTSTEEGT<br>SESATPESGPGTS<br>TEPSEGSAPGTST<br>EPSEGSAPGTSES<br>ATPESGPGTSTPE<br>SGSASPGSTSESP<br>SGTAPGSTSSTAE<br>SPGPGTSESATPE<br>SGPGTSTEPSEGS<br>APGTSTEPSEGSA<br>P | 638 |
| LCW462_r64 | GGTACTTCTACCGAACCGTCCGAGGGCAGCGCTCCAG<br>GTACTTCTACTGAACCTTCTGAAGGCAGCGCTCCAGG<br>TACTTCTACTGAACCTTCCGAAGGTAGCGCACCAGGT<br>ACCTCTACCGAACCGTCTGAAGGTAGCGCACCAGGTA<br>CCTCTGAAAGCGCAACTCCTGAGTCCGGTCCAGGTAC<br>TTCTGAAAGCGCAACCCCGGAGTCTGGCCCAGGTACT<br>CCTGGCAGCGGTACCGCATCTTCCTCTCCAGGTAGCT<br>CTACTCCGTCGGTGCAACTGGTTCCCCAGGTGCTTCT<br>CCGGGTACCAGCTCTACCGGTTCTCCAGGTTCCACCA<br>GCTCTACTGCTGAATCTCCTGGTCCAGGTACCTCTCCT<br>AGCGGTAATCTTCTACTGCTCCAGGTACTTCTACTCC<br>TGAAAGCGGCTCTGCTTCTCCA | 606 | GTSTEPSEGSAPG<br>TSTEPSEGSAPGT<br>STEPSEGSAPGTS<br>TEPSEGSAPGTSE<br>SATPESGPGTSES<br>ATPESGPGTPGSG<br>TASSSPGSSTPSG<br>ATGSPGASPGTSS<br>TGPGSTSSTAES<br>PGPGTSPSGESST<br>APGTSTPESGSAS<br>P | 639 |
| LCW462_r67 | GGTAGCCCGGCAGGCTCTCCGACCTCTACTGAGGAAG<br>GTACTTCTGAAAGCGCAACCCCGGAGTCCGGCCCAGG<br>TACCTCTACCGAACCGTCTGAGGGCAGCGCACCAGGT<br>ACTTCTGAAAGCGCAACCCCTGAATCCGGTCCAGGTA<br>GCGAACCGGCTACTTCTGGCTCTGAGACTCCAGGTAC<br>TTCTACCGAACCGTCCGAAGGTAGCGCACCAGGTAGC<br>CCGGCTGGTTCTCCGACTTCCACCGAGGAAGGTACCT<br>CTACTGAACCTTCTGAGGGTAGCGCTCCAGGTACCTC<br>TACTGAACCTTCCGAAGGCAGCGCTCCAGGTACTTCT<br>ACCGAACCGTCCGAGGGCAGCGCTCCAGGTACTTCTA<br>CTGAACCTTCTGAAGGCAGCGCTCCAGGTACTTCTAC<br>TGAACCTTCCGAAGGTAGCGCACCA | 607 | GSPAGSPTSTEEG<br>TSESATPESGPGT<br>STEPSEGSAPGTS<br>ESATPESGPGSEP<br>ATSGSETPGTSTE<br>PSEGSAPGSPAGS<br>PTSTEEGTSTEPS<br>EGSAPGTSTEPSE<br>GSAPGTSTEPSEG<br>SAPGTSTEPSEGS<br>APGTSTEPSEGSA<br>P | 640 |
| LCW462_r69 | GGTACTTCTCCGAGCGGTGAATCTTCTACCGCACCAG<br>GTTCTACTAGCTCTACCGCTGAATCTCCGGGCCCAGG<br>TACTTCTCCGAGCGGTGAATCTTCTACTGCTCCAGGT<br>ACCTCTGAAAGCGCTACTCCGGAGTCTGGCCCAGGTA<br>CCTCTACTGAACCGTCTGAGGGTAGCGCTCCAGGTAC<br>TTCTACTGAACCGTCCGAAGGTAGCGCACCAGGTTCT<br>AGCCCTTCTGCATCTACTGGTACTGGCCCAGGTAGCT<br>CTACTCCTTCTGGTGCTACCGGCTCTCCAGGTGCTTCT<br>CCGGGTACTAGCTCTACCGGTTCTCCAGGTACTTCTA | 608 | GTSPSGESSTAPG<br>STSSTAESPGPGT<br>SPSGESSTAPGTS<br>ESATPESGPGTST<br>EPSEGSAPGTSTE<br>PSEGSAPGSSPSA<br>STGTGPGSSTPSG<br>ATGSPGASPGTSS<br>TGSPGTSTPESGS | 641 |

TABLE 15-continued

DNA and amino acid sequences for AM144 segments

| Clone | Sequence Trimmed | SEQ ID NO: | Protein Sequence | SEQ ID NO: |
|---|---|---|---|---|
| | CTCCGGAAAGCGGTTCCGCATCTCCAGGTACTTCTCC TAGCGGTGAATCTTCTACTGCTCCAGGTACCTCTCCTA GCGGCGAATCTTCTACTGCTCCA | | ASPGTSPSGESST APGTSPSGESSTA P | |
| LCW462_r70 | GGTACCTCTGAAAGCGCTACTCCGGAGTCTGGCCCAG GTACCTCTACTGAACCGTCTGAGGGTAGCGCTCCAGG TACTTCTACTGAACCGTCCGAAGGTAGCGCACCAGGT AGCCCTGCTGGCTCTCCGACTTCTACTGAGGAAGGTA GCCCGGCTGGTTCTCCGACTTCTACTGAGGAAGGTAC TTCTACCGAACCTTCCGAAGGTAGCGCTCCAGGTTCT AGCCCTTCTGCTTCCACCGGTACTGGGCCCAGGTAGCT CTACCCCTTCTGGTGCTACCGGCTCCCCAGGTAGCTCT ACTCCTTCTGGTGCAACTGGCTCTCCAGGTAGCGAAC CGGCAACTTCCGGCTCTGAAACCCCAGGTACTTCTGA AAGCGCTACTCCTGAGTCTGGCCCAGGTAGCGAACCT GCTACCTCTGGCTCTGAAACCCCA | 609 | GTSESATPESGPG TSTEPSEGSAPGT STEPSEGSAPGSP AGSPTSTEEGSPA GSPTSTEEGTSTE PSEGSAPGSSPSA STGTGPGSSTPSG ATGSPGSSTPSGA TGSPGSEPATSGS ETPGTSESATPES GPGSEPATSGSET P | 642 |
| LCW462_r72 | GGTACTTCTACCGAACCGTCCGAAGGCAGCGCTCCAG GTACCTCTACTGAACCTTCCGAGGGCAGCGCTCCAGG TACCTCTACCGAACCTTCTGAAGGTAGCGCACCAGGT AGCTCTACCCCGTCTGGTGCTACCGGTTCCCCAGGTG CTTCTCCTGGTACTAGCTCTACCGGTTCTCCAGGTAGC TCTACCCCGTCTGGTGCTACTGGCTCTCCAGGTACTTC TGAAAGCGCAACCCCTGAATCCGGTCCAGGTAGCGA ACCGGCTACTTCTGGCTCTGAGACTCCAGGTACTTCT ACCGAACCGTCCGAAGGTAGCGCACCAGGTTCTACTA GCGAATCTCCTTCTGGCACTGCACCAGGTTCTACCAG CGAATCTCCGTCTGGCACTGCACCAGGTACCTCTACC CCTGAAAGCGGTTCCGCTTCTCCA | 610 | GTSTEPSEGSAPG TSTEPSEGSAPGT STEPSEGSAPGSS TPSGATGSPGASP GTSSTGPGSSTP SGATGSPGTSESA TPESGPGSEPATS GSETPGTSTEPSE GSAPGSTSESPSG TAPGSTSESPSGT APGTSTPESGSAS P | 643 |
| LCW462_r73 | GGTACCTCTACTCCTGAAAGCGGTTCTGCATCTCCAG GTTCCACTAGCTCTACCGCAGAATCTCCGGGCCCAGG TTCCACTAGCTCTACTGCTGAATCTCCTGGCCCAGGTT CTAGCCCTTCTGCATCTACTGGTACTGGCCCAGGTAG CTCTACTCCTTCTGGTGCTACCGGCTCTCCAGGTGCTT CTCCGGGTACTAGCTCTACCGGTTCTCCAGGTAGCGA ACCGGCAACCTCCGGCTCTGAAACCCCAGGTACCTCT GAAAGCGCTACTCCTGAATCCGGCCCAGGTAGCCCGG CAGGTTCTCCGACTTCCACTGAGGAAGGTTCTACTAG CGAATCTCCTTCTGGCACTGCACCAGGTTCTACCAGC GAATCTCCGTCTGGCACTGCACCAGGTACCTCTACCC CTGAAAGCGGTTCCGCTTCTCCC | 611 | GTSTPESGSASPG STSSTAESPGPGS TSSTAESPGPGSS PSASTGTGPGSST PSGATGSPGASPG TSSTGSPGSEPAT SGSETPGTSESAT PESGPGSPAGSPT STEEGSTSESPSG TAPGSTSESPSGT APGTSTPESGSAS P | 644 |
| LCW462_r78 | GGTAGCCCGGCTGGCTCTCCTACCTCTACTGAGGAAG GTACTTCTGAAAGCGCTACTCCTGAGTCTGGTCCAGG TACCTCTACTGAACCGTCCGAAGGTAGCGCTCCAGGT TCTACCAGCGAATCTCCTTCTGGCACCGCTCCAGGTT CTACTAGCGAATCCCGTCTGGTACCGCACCAGGTAC TTCTCCTAGCGGCGAATCTTCTACCGCACCAGGTACC TCTACCGAACCTTCCGAAGGTAGCGCTCCAGGTAGCC CGGCAGGTTCTCCTACTTCCACTGAGGAAGGTACTTC TACCGAACCTTCTGAGGGTAGCGCACCAGGTAGCGA ACCTGCAACCTCTGGCTCTGAAACCCCAGGTACCTCT GAAAGCGCTACTCCTGAATCTGGCCCAGGTACTTCTA CTGAACCGTCCGAGGGCAGCGCACCA | 612 | GSPAGSPTSTEEG TSESATPESGPGT STEPSEGSAPGST SESPSGTAPGSTS ESPSGTAPGTSPS GESSTAPGTSTEP SEGSAPGSPAGSP TSTEEGTSTEPSE GSAPGSEPATSGS ETPGTSESATPES GPGTSTEPSEGSA P | 645 |
| LCW462_r79 | GGTACCTCTACCGAACCTTCCGAAGGTAGCGCTCCAG GTAGCCCGGCAGGTTCTCCTACTTCCACTGAGGAAGG TACTTCTACCGAACCTTCTGAGGGTAGCGCACCAGGT ACCTCCCCTAGCGGCGAATCTTCTACTGCTCCAGGTA CCTCTCCTAGCGGCGAATCTTCTACCGCTCCAGGTAC CTCCCCTAGCGGTGAATCTTCTACCGCACCAGGTTCT ACCAGCGAATCCCCTTCTGGTACTGCTCCAGGTTCTA CCAGCGAATCCCCTTCTGGCACCGCACCAGGTACTTC TACCCCTGAAAGCGGTTCCGCTTCTCCAGGTAGCGAA CCTGCAACCTCTGGCTCTGAAACCCCAGGTACCTCTG AAAGCGCTACTCCTGAATCTGGCCCAGGTACTTCTAC TGAACCGTCCGAGGGCAGCGCACCA | 613 | GTSTEPSEGSAPG SPAGSPTSTEEGT STEPSEGSAPGTS PSGESSTAPGTSP SGESSTAPGTSPS GESSTAPGSTSES PSGTAPGSTSESP SGTAPGTSTPESG SASPGSEPATSGS ETPGTSESATPES GPGTSTEPSEGSA P | 646 |
| LCW462_r87 | GGTAGCGAACCGGCAACCTCTGGCTCTGAAACCCCAG GTACCTCTGAAAGCGCTACTCCGGAATCTGGTCCAGG TACTTCTGAAAGCGCTACTCCGGAATCCGGTCCAGGT ACTTCTCCGAGCGGTGAATCTTCTACCGCACCAGGTT CTACTAGCTCTACCGCTGAATCTCCGGGCCCAGGTAC | 614 | GSEPATSGSETPG TSESATPESGPGT SESATPESGPGTS PSGESSTAPGSTS STAESPGPGTSPS | 647 |

TABLE 15-continued

DNA and amino acid sequences for AM144 segments

| Clone | Sequence Trimmed | SEQ ID NO: | Protein Sequence | SEQ ID NO: |
|---|---|---|---|---|
| | TTCTCCGAGCGGTGAATCTTCTACTGCTCCAGGTTCTA | | GESSTAPGSTSES | |
| | CTAGCGAATCCCCGTCTGGTACTGCTCCAGGTACTTC | | PSGTAPGTSPSGE | |
| | CCCTAGCGGTGAATCTTCTACTGCTCCAGGTTCTACC | | SSTAPGSTSSTAE | |
| | AGCTCTACCGCAGAATCTCCGGGTCCAGGTAGCTCTA | | SPGPGSSTPSGAT | |
| | CTCCGTCTGGTGCAACCGGTTCCCCAGGTAGCTCTAC | | GSPGSSTPSGATG | |
| | CCCTTCTGGTGCAACCGGCTCCCCAGGTAGCTCTACC | | SPGSSTPSGANW | |
| | CCTTCTGGTGCAAACTGGCTCTCC | | LS | |
| LCW462_r88 | GGTAGCCCTGCTGGCTCTCCGACTTCTACTGAGGAAG | 615 | GSPAGSPTSTEEG | 648 |
| | GTAGCCCGGCTGGTTCTCCGACTTCTACTGAGGAAGG | | SPAGSPTSTEEGT | |
| | TACTTCTACCGAACCTTCCGAAGGTAGCGCTCCAGGT | | STEPSEGSAPGTS | |
| | ACCTCTACTGAACCTTCCGAAGGCAGCGCTCCAGGTA | | TEPSEGSAPGTST | |
| | CCTCTACCGAACCGTCCGAGGGCAGCGCACCAGGTAC | | EPSEGSAPGTSES | |
| | TTCTGAAAGCGCAACCCCTGAATCCGGTCCAGGTGCA | | ATPESGPGASPGT | |
| | TCTCCTGGTACCAGCTCTACCGGTTCTCCAGGTAGCTC | | SSTGSPGSSTPSG | |
| | TACTCCTTCTGGTGCTACTGGCTCTCCAGGTGCTTCCC | | ATGSPGASPGTSS | |
| | CGGGTACCAGCTCTACCGGTTCTCCAGGTAGCTCTAC | | TGSPGSSTPSGAT | |
| | CCCGTCTGGTGCTACTGGTTCTCCAGGTACTCCGGGC | | GSPGTPGSGTASS | |
| | AGCGGTACTGCTTCTTCCTCTCCAGGTAGCTCTACCCC | | SPGSSTPSGATGS | |
| | TTCTGGTGCTACTGGCTCTCCA | | P | |
| LCW462_r89 | GGTAGCTCTACCCCGTCTGGTGCTACTGGTTCTCCAG | 616 | GSSTPSGATGSPG | 649 |
| | GTACTCCGGGCAGCGGTACTGCTTCTTCCTCTCCAGG | | TPGSGTASSSPGS | |
| | TAGCTCTACCCCTTCTGGTGCTACTGGCTCTCCAGGTA | | STPSGATGSPGSP | |
| | GCCCGGCTGGCTCTCCTACCTCTACTGAGGAAGGTAC | | AGSPTSTEEGTSE | |
| | TTCTGAAAGCGCTACTCCTGAGTCTGGTCCAGGTACC | | SATPESGPGTSTE | |
| | TCTACTGAACCGTCCGAAGGTAGCGCTCCAGGTACCT | | PSEGSAPGTSESA | |
| | CTGAAAGCGCAACTCCTGAGTCTGGCCCAGGTAGCGA | | TPESGPGSEPATS | |
| | ACCTGCTACCTCCGGCTCTGAGACTCCAGGTACCTCT | | GSETPGTSESATP | |
| | GAAAGCGCAACCCCGGAATCTGGTCCAGGTACTTCTA | | ESGPGTSTEPSEG | |
| | CTGAACCGTCTGAAGGTAGCGCACCAGGTACTTCTGA | | SAPGTSESATPES | |
| | AAGCGCAACCCCGGAATCCGGCCCAGGTACCTCTGA | | GPGTSESATPESG | |
| | AAGCGCAACCCCGGAGTCCGGCCCA | | P | |

Example 7

Construction of XTEN_AM288

The entire library LCW0462 was dimerized as described in Example 6 resulting in a library of XTEN_AM288 clones designated LCW0463. 1512 isolates from library LCW0463 were screened using the protocol described in Example 6. 176 highly expressing clones were sequenced and 40 preferred XTEN_AM288 segments were chosen for the construction of multifunctional proteins that contain multiple XTEN segments with 288 amino acid residues.

Example 8

Construction of XTEN_AM432

We generated a library of XTEN_AM432 segments by recombining segments from library LCW0462 of XTEN_AM144 segments and segments from library LCW0463 of XTEN_AM288 segments. This new library of XTEN_AM432 segment was designated LCW0464. Plasmids were isolated from cultures of *E. coli* harboring LCW0462 and LCW0463, respectively. 1512 isolates from library LCW0464 were screened using the protocol described in Example 6. 176 highly expressing clones were sequenced and 39 preferred XTEN_AM432 segment were chosen for the construction of longer XTENs and for the construction of multifunctional proteins that contain multiple XTEN segments with 432 amino acid residues.

In parallel we constructed library LMS0100 of XTEN_AM432 segments using preferred segments of XTEN_AM144 and XTEN_AM288. Screening this library yielded 4 isolates that were selected for further construction

Example 9

Construction of XTEN_AM875

The stuffer vector pCW0359 was digested with BsaI and KpnI to remove the stuffer segment and the resulting vector fragment was isolated by agarose gel purification.

We annealed the phosphorylated oligonucleotide BsaI-AscI-KpnIforP: AGGTGCAAGCGCAAGCGGCGCGC-CAAGCACGGGAGGTTCGTCTTCACTCGAGGGTAC (SEQ ID NO: 650) and the non-phosphorylated oligonucleotide BsaI-AscI-KpnIrev: CCTCGAGTGAAGACGAAC-CTCCCGTGCTTGGCGCGCCGCTTGCGCTTGC (SEQ ID NO: 651) for introducing the sequencing island A (SI-A) which encodes amino acids GASASGAPSTG (SEQ ID NO: 652) and has the restriction enzyme AscI recognition nucleotide sequence GGCGCGCC inside. The annealed oligonucleotide pairs were ligated with BsaI and KpnI digested stuffer vector pCW0359 prepared above to yield pCW0466 containing SI-A. We then generated a library of XTEN_AM443 segments by recombining 43 preferred XTEN_AM432 segments from Example 8 and SI-A segments from pCW0466 at C-terminus using the same dimerization process described in Example 5. This new library of XTEN_AM443 segments was designated LCW0479.

We generated a library of XTEN_AM875 segments by recombining segments from library LCW0479 of XTEN_AM443 segments and 43 preferred XTEN_AM432 segments from Example 8 using the same dimerization process described in example 5. This new library of XTEN_AM875 segment was designated LCW0481.

Example 10

Construction of XTEN_AM1318

We annealed the phosphorylated oligonucleotide BsaI-FseI-KpnIforP: AGGTCCAGAACCAACGGGGCCGGC-CCCAAGCGGAGGTTCGTCTTCACTCGAGGGTAC (SEQ ID NO: 653) and the non-phosphorylated oligonucleotide BsaI-FseI-KpnIrev: CCTCGAGTGAAGACGAAC-CTCCGCTTGGGGCCGGCCCCGTTGGTTCTGG (SEQ ID NO: 654) for introducing the sequencing island B (SI-B) which encodes amino acids GPEPTGPAPSG (SEQ ID NO: 655) and has the restriction enzyme FseI recognition nucleotide sequence GGCCGGCC inside. The annealed oligonucleotide pairs were ligated with BsaI and KpnI digested stuffer vector pCW0359 as used in Example 9 to yield pCW0467 containing SI-B. We then generated a library of XTEN_AM443 segments by recombining 43 preferred XTEN_AM432 segments from Example 8 and SI-B segments from pCW0467 at C-terminus using the same dimerization process described in example 5. This new library of XTEN_AM443 segments was designated LCW0480.

We generated a library of XTEN_AM1318 segments by recombining segments from library LCW0480 of XTEN_AM443 segments and segments from library LCW0481 of XTEN_AM875 segments using the same dimerization process as in example 5. This new library of XTEN_AM1318 segment was designated LCW0487.

Example 11

Construction of XTEN_AD864

Using the several consecutive rounds of dimerization, we assembled a collection of XTEN_AD864 sequences starting from segments of XTEN_AD36 listed in Example 1. These sequences were assembled as described in Example 5. Several isolates from XTEN_AD864 were evaluated and found to show good expression and excellent solubility under physiological conditions. One intermediate construct of XTEN_AD576 was sequenced. This clone was evaluated in a PK experiment in cynomolgus monkeys and a half-life of about 20 h was measured.

Example 12

Construction of XTEN_AF864

Using the several consecutive rounds of dimerization, we assembled a collection of XTEN_AF864 sequences starting from segments of XTEN_AF36 listed in Example 3. These sequences were assembled as described in Example 5. Several isolates from XTEN_AF864 were evaluated and found to show good expression and excellent solubility under physiological conditions. One intermediate construct of XTEN_AF540 was sequenced. This clone was evaluated in a PK experiment in cynomolgus monkeys and a half-life of about 20 h was measured. A full length clone of XTEN_AF864 had excellent solubility and showed half-life exceeding 60 h in cynomolgus monkeys. A second set of XTEN_AF sequences was assembled including a sequencing island as described in Example 9.

Example 13

Construction of XTEN_AG864

Using the several consecutive rounds of dimerization, we assembled a collection of XTEN_AG864 sequences starting from segments of XTEN_AD36 listed in Example 1. These sequences were assembled as described in Example 5. Several isolates from XTEN_AG864 were evaluated and found to show good expression and excellent solubility under physiological conditions. A full length clone of XTEN_AG864 had excellent solubility and showed half-life exceeding 60 h in cynomolgus monkeys.

Example 14

Construction of N-Terminal Extensions of XTEN-Construction and Screening of 12mer Addition Libraries This example details a step in the optimization of the N-terminus of the XTEN protein to promote the initiation of translation to allow for expression of XTEN fusions at the N-terminus of fusion proteins without the presence of a helper domain. Historically expression of proteins with XTEN at the N-terminus was poor, yielding values that would essentially undetectable in the GFP fluorescence assay (<25% of the expression with the N-terminal CBD helper domain). To create diversity at the codon level, seven amino acid sequences were selected and prepared with a diversity of codons. Seven pairs of oligonucleotides encoding 12 amino acids with codon diversities were designed, annealed and ligated into the NdeI/BsaI restriction enzyme digested stuffer vector pCW0551 (Stuffer-XTEN_AM875-GFP), and transformed into E. coli BL21Gold(DE3) competent cells to obtain colonies of seven libraries. The resulting clones have N-terminal XTEN 12mers fused in-frame to XTEN_AM875-GFP to allow use of GFP fluorescence for screening the expression. Individual colonies from the seven created libraries were picked and grown overnight to saturation in 500 µl of super broth media in a 96 deep well plate. The number of colonies picked ranged from approximately half to a third of the theoretical diversity of the library (see Table 16).

TABLE 16

Theoretical Diversity and Sampling Numbers for 12mer Addition Libraries. The amino acid residues with randomized codons are underlined.

| Library | Motif Family | Amino Acid Sequence | SEQ ID NO: | Theoretical Diversity | Number screened |
|---------|--------------|---------------------|------------|-----------------------|-----------------|
| LCW546 | AE12 | MASPAGSPTSTEE | 656 | 572 | 2 plates (168) |
| LCW547 | AE12 | MATSESATPESGP | 657 | 1536 | 5 plates (420) |
| LCW548 | AF12 | MATSPSGESSTAP | 658 | 192 | 2 plates (168) |
| LCW549 | AF12 | MESTSSTAESPGP | 659 | 384 | 2 plates (168) |

TABLE 16-continued

Theoretical Diversity and Sampling Numbers for 12mer Addition Libraries. The amino acid residues with randomized codons are underlined.

| Library | Motif Family | Amino Acid Sequence | SEQ ID NO: | Theoretical Diversity | Number screened |
|---------|--------------|---------------------|------------|----------------------|-----------------|
| LCW552  | AG12         | MA<u>SSTPSGATGSP</u> | 660        | 384                  | 2 plates (168)  |
| LCW553  | AG12         | ME<u>ASPGTSSTGSP</u> | 661        | 384                  | 2 plates (168)  |
| LCW554  | (CBD-like)   | M<u>ASTPESGSSG</u>   | 662        | 32                   | 1 plate (84)    |

Figure 11:
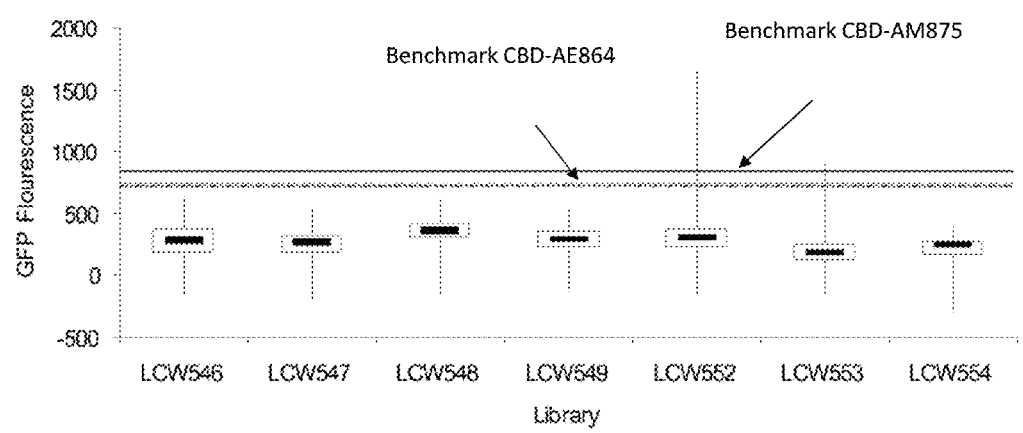
FIG. 11 shows results of expression assays for the indicated constructs comprising GFP and XTEN sequences, conducted as described in Example 14. The expression cultures were assayed using a fluorescence plate reader (excitation 395 nm, emission 510 nm) to determine the amount of GFP reporter present and the results are graphed as box and whisker plots.

The saturated overnight cultures were used to inoculate fresh 500 µl cultures in auto-induction media in which they were grown overnight at 26° C. These expression cultures were then assayed using a fluorescence plate reader (excitation 395 nm, emission 510 nm) to determine the amount of GFP reporter present (see FIG. 11 for results of expression assays). The results, graphed as box and whisker plots, indicate that while median expression levels were approximately half of the expression levels compared to the "benchmark" CBD N-terminal helper domain, the best clones from the libraries were much closer to the benchmarks, indicating that further optimization around those sequences was warranted. This is in contrast to previous XTEN versions that were <25% of the expression levels of the CBD N-terminal benchmark. The results also show that the libraries starting with amino acids MA had better expression levels than those beginning with ME. This was most apparent when looking at the best clones, which were closer to the benchmarks as they mostly start with MA. Of the 176 clones within 33% of the CBD-AM875 benchmark, 87% begin with MA, whereas only 75% of the sequences in the libraries beginning with MA, a clear over representation of the clones beginning with MA at the highest level of expression. 96 of the best clones were sequenced to confirm identity and twelve sequences (see Table 17), 4 from LCW546, 4 from LCW547 and 4 from LCW552 were selected for further optimization.

TABLE 17

Advanced 12mer DNA Sequences

| Clone | DNA Sequence | SEQ ID NO: |
|-------|--------------|------------|
| LCW546_02 | ATGGCTAGTCCGGCTGGCTCTCCGACCTCCACTGAGGAAGGTACTTCTACT | 663 |
| LCW546_06 | ATGGCTAGTCCTGCTGGCTCTCCAACCTCCACTGAGGAAGGTACTTCTACT | 664 |
| LCW546_07 | ATGGCTAGTCCAGCAGGCTCTCCTACCTCCACCGAGGAAGGTACTTCTACT | 665 |
| LCW546_09 | ATGGCTAGTCCTGCTGGCTCTCCGACCTCTACTGAGGAAGGTACTTCTACT | 666 |
| LCW547_03 | ATGGCTACATCCGAAAGCGCAACCCCTGAGTCCGGTCCAGGTACTTCTACT | 667 |
| LCW547_06 | ATGGCTACATCCGAAAGCGCAACCCCTGAATCTGGTCCAGGTACTTCTACT | 668 |
| LCW547_10 | ATGGCTACGTCTGAAAGCGCTACTCCGGAATCTGGTCCAGGTACTTCTACT | 669 |
| LCW547_17 | ATGGCTACGTCCGAAAGCGCTACCCCTGAATCCGGTCAGGTACTTCTACT | 670 |

TABLE 17-continued

Advanced 12mer DNA Sequences

| Clone | DNA Sequence | SEQ ID NO: |
|-------|--------------|------------|
| LCW552_03 | ATGGCTAGTTCTACCCCGTCTGGTGCAACCGGTTCCCAGGTACTTCTACT | 671 |
| LCW552_05 | ATGGCTAGCTCCACTCCGTCTGGTGCTACCGGTTCCCAGGTACTTCTACT | 672 |
| LCW552_10 | ATGGCTAGCTCTACTCCGTCTGGTGCTACTGGTTCCCAGGTACTTCTACT | 673 |
| LCW552_11 | ATGGCTAGTTCTACCCCTTCTGGTGCTACTGGTTCTCCAGGTACTTCTACT | 674 |

Example 15

Construction of N-Terminal Extensions of XTEN-Construction and Screening of Libraries Optimizing Codons 3 and 4

Figure 13:
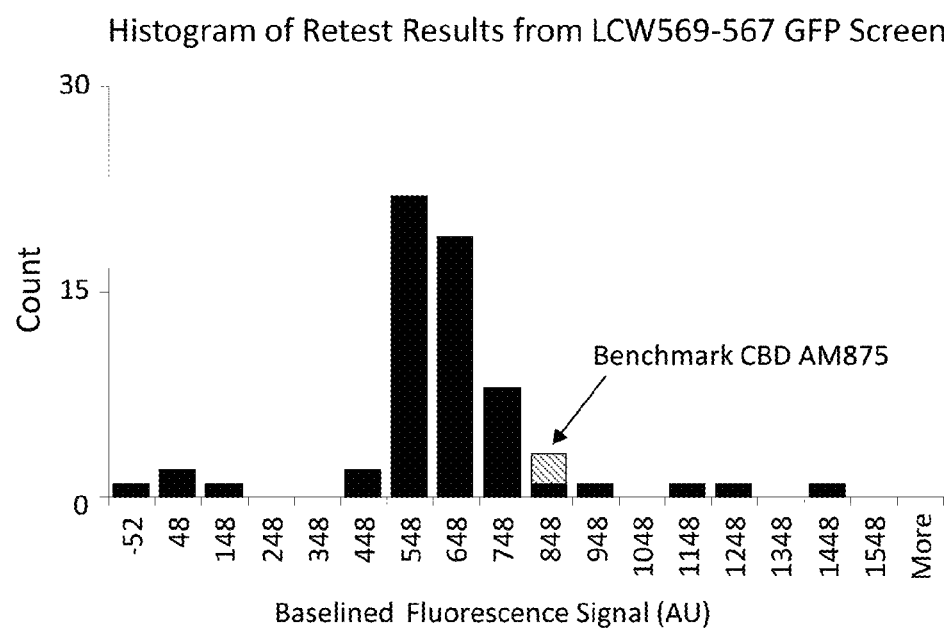
FIG. 13 shows a histogram of a retest of the top 75 clones after the optimization step, as described in Example 15, for GFP fluorescence signal relative to the benchmark CBD_AM875 construct. The results indicated that several clones were now superior to the benchmark clones seen in FIG. 11.

This example details a step in the optimization of the N-terminus of the XTEN protein to promote the initiation of translation to allow for expression of XTEN fusions at the N-terminus of proteins without the presence of a helper domain. With preferences for the first two codons established (see Example supra), the third and fourth codons were randomized to determine preferences. Three libraries, based upon best clones from LCW546, LCW547 and LCW552, were designed with the third and fourth residues modified such that all combinations of allowable XTEN codons were present at these positions (see FIG. 12). In order to include all the allowable XTEN codons for each library, nine pairs of oligonucleotides encoding 12 amino acids with codon diversities of third and fourth residues were designed, annealed and ligated into the NdeI/BsaI restriction enzyme digested stuffer vector pCW0551 (Stuffer-XTEN_AM875-GFP), and transformed into E. coli BL21Gold(DE3) competent cells to obtain colonies of three libraries LCW0569-571. With 24 XTEN codons the theoretical diversity of each library is 576 unique clones. A total of 504 individual colonies from the three created libraries were picked and grown overnight to saturation in 500 µl of super broth media in a 96 deep well plate. This provided sufficient coverage to understand relative library performance and sequence preferences. The saturated overnight cultures were used to inoculate new 500 µl cultures in auto-induction media in which were grown overnight at 26° C. These expression cultures were then assayed using a fluorescence plate reader (excitation 395 nm, emission 510 nm) to determine the amount of GFP reporter present. The top 75 clones from the screen were sequenced and retested for GFP reporter expression versus the benchmark samples (see FIG. 13). 52 clones yielded usable sequencing data and were used for subsequent analysis. The results were broken down by library and indicate that LCW546 was the superior library. The results are presented in Table 18. Surprisingly, it was discovered that base-lined fluorescence readings for the best clones were ~900 AU, whereas the CBD N-terminal benchmark was only ~600 AU. This indicates that this library had instituted an approximately 33% improvement over the best clones from the previous library which were approximately equal in expression to the CBD N-terminal benchmark (Example 14).

TABLE 18

Third and Fourth Codon Optimization Library Comparison

|  | LCW569 | LCW570 | LCW571 |
|---|---|---|---|
| N | 21 | 15 | 16 |
| Mean Fluorescence (AU) | 628 | 491 | 537 |
| SD | 173 | 71 | 232 |
| CV | 28% | 15% | 43% |

Further trends were seen in the data showing preferences for particular codons at the third and fourth position. Within the LCW569 library the glutamate codon GAA at the third position and the threonine codon ACT were associated with higher expression as seen in Table 19.

TABLE 19

Preferred Third and Fourth Codons in LCW569

|  | 3 = GAA | Rest | 4 = ACT | Rest |
|---|---|---|---|---|
| N | 8 | 13 | 4 | 17 |
| Mean Fluorescence (AU) | 749 | 554 | 744 | 601 |
| SD | 234 | 47 | 197 | 162 |
| CV | 31% | 9% | 26% | 27% |

Additionally, the retest of the top 75 clones indicated that several were now superior to the benchmark clones.

Example 16

Figure 14:
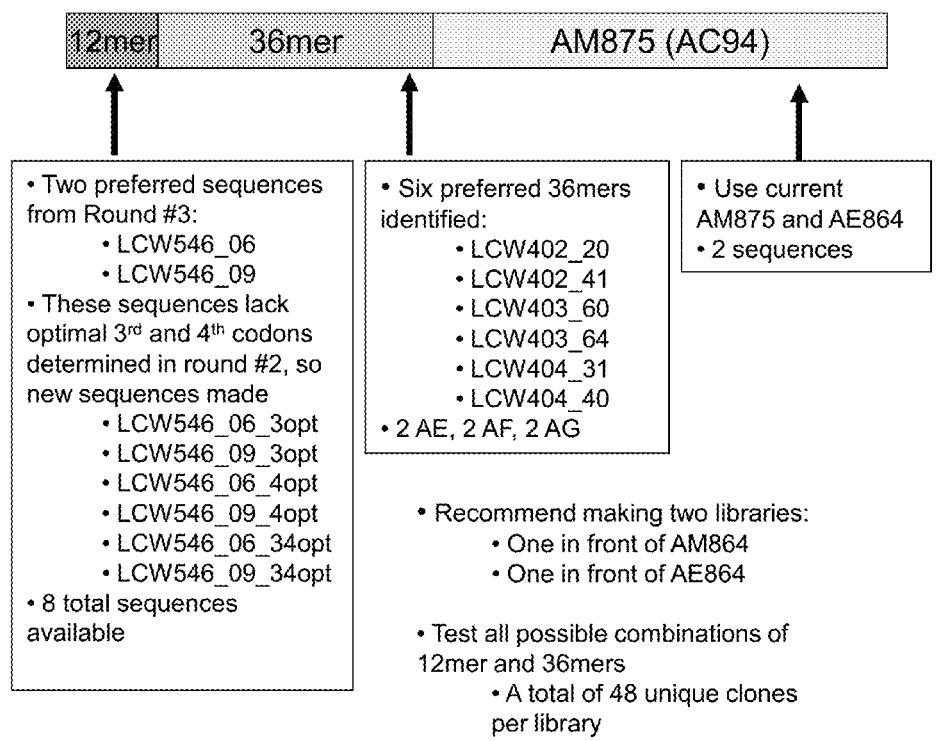
FIG. 14 is a schematic of a combinatorial approach undertaken for the union of codon optimization preferences for two regions of the N-terminus 48 amino acids. The approach created novel 48mers at the N-terminus of the XTEN protein for evaluation of the optimization of expression for leader sequences to enhance expression of XTEN proteins where the XTEN is N-terminal to the targeting moieties.

Construction of N-Terminal Extensions of XTEN-Construction and Screening of Combinatorial 12mer and 36mer Libraries This example details a step in the optimization of the N-terminus of the XTEN protein to promote the initiation of translation to allow for expression of XTEN fusions at the N-terminus of proteins without the presence of a helper domain. With preferences for the first two codons established (see Example supra), the N-terminus was examined in a broader context by combining the 12 selected 12mer sequences (see Example supra) at the very N-terminus followed by 125 previously constructed 36mer segments (see example supra) in a combinatorial manner. This created novel 48mers at the N-terminus of the XTEN protein and enabled the assessment of the impact of longer-range interactions at the N-terminus on expression of the longer sequences (FIG. 14). Similar to the dimerization procedures used to assemble 36mers (see Example infra), the plasmids containing the 125 selected 36mer segments were digested with restriction enzymes BbsI/NcoI and the appropriate fragment was gel-purified. The plasmid from clone AC94 (CBD-XTEN_AM875-GFP) was also digested with BsaI/NcoI and the appropriate fragments were gel-purified. These fragments were ligated together and transformed into *E. coli* BL21Gold(DE3) competent cells to obtain colonies of the library LCW0579, which also served as the vector for further cloning 12 selected 12mers at the very N-terminus. The plasmids of LCW0579 were digested with NdeI/EcoRI/BsaI and the appropriate fragments were gel-purified. 12 pairs of oligonucleotides encoding 12 selected 12mer sequences were designed, annealed and ligated with the NdeI/EcoRI/BsaI digested LCW0579 vector, and transformed into *E. coli* BL21Gold (DE3) competent cells to obtain colonies of the library LCW0580. With a theoretical diversity of 1500 unique clones, a total of 1512 individual colonies from the created library were picked and grown overnight to saturation in 500 μl of super broth media in a 96 deep well plate. This provided sufficient coverage to understand relative library performance and sequence preferences. The saturated overnight cultures were used to inoculate new 500 μl cultures in auto-induction media that were grown overnight at 26° C. These expression cultures were then assayed using a fluorescence plate reader (excitation 395 nm, emission 510 nm) to determine the amount of GFP reporter present. The top 90 clones were sequenced and retested for GFP reporter expression. 83 clones yielded usable sequencing data and were used for subsequent analysis. The sequencing data was used to determine the lead 12mer that was present in each clone and the impact of each 12mer on expression was assessed. Clones LCW546_06 and LCW546_09 stood out as being the superior N-terminus (see Table 20).

TABLE 20

Relative Performance of Clones Starting with LCW546_06 and LCW459_09

|  | LCW546_06 | All Others | LCW546_09 | All Others |
|---|---|---|---|---|
| N | 11 | 72 | 9 | 74 |
| Mean Fluorescence (AU) | 1100 | 752 | 988 | 775 |
| SD | 275 | 154 | 179 | 202 |
| CV | 25% | 20% | 18% | 26% |

The sequencing and retest also revealed several instances of independent replicates of the same sequence in the data producing similar results, thus increasing confidence in the assay. Additionally, 10 clones with 6 unique sequences were superior to the benchmark clone. They are presented in Table 21. It was noted that these were the only occurrences of these sequences and in no case did one of these sequences occur and fail to beat the bench-mark clone. These six sequences were advanced for further optimization.

TABLE 21

Combinatorial 12mer and 36mer Clones Superior to Benchmark Clone

| Clone Name | First 60 codons | SEQ ID NO: | 12mer Name | 36mer Name |
|---|---|---|---|---|
| LCW580_51 | ATGGCTAGTCCTGCTGGCTCTCCAACCTC CACTGAGGAAGGTGCATCCCCGGGCACC AGCTCTACCGGTTCTCCAGGTAGCTCTAC CCCGTCTGGTGCTACCGGCTCTCCAGGTA GCTCTACCCCGTCTGGTGCTACTGGCTCT CCAGGTACTTCTACTGAACCGTCTGAAG GCAGCGCA | 675 | LCW546_06 | LCW0404_040 |
| LCW580_81 | ATGGCTAGTCCTGCTGGCTCTCCAACCTC CACTGAGGAAGGTGCATCCCCGGGCACC AGCTCTACCGGTTCTCCAGGTAGCTCTAC CCCGTCTGGTGCTACCGGCTCTCCAGGTA GCTCTACCCCGTCTGGTGCTACTGGCTCT CCAGGTACTTCTACTGAACCGTCTGAAG GCAGCGCA | 676 | LCW546_06 | LCW0404_040 |
| LCW580_38 | ATGGCTAGTCCTGCTGGCTCTCCAACCTC CACTGAGGAAGGTACTTCTACCGAACCG TCCGAGGGTAGCGCACCAGGTAGCCCAG CAGGTTCTCCTACCTCCACCGAGGAAGG TACTTCTACCGAACCGTCCGAGGGTAGC GCACCAGGTACTTCTACTGAACCGTCTG AAGGCAGCGCA | 677 | LCW546_06 | LCW0402_041 |
| LCW580_63 | ATGGCTAGTCCTGCTGGCTCTCCGACCTC TACTGAGGAAGGTACTTCTACTGAACCG TCTGAAGGCAGCGCACCAGGTAGCGAAC CGGCTACTTCCGGTTCTGAAACCCCAGGT AGCCCAGCAGGTTCTCCAACTTCTACTGA AGAAGGTACTTCTACTGAACCGTCTGAA GGCAGCGCA | 678 | LCW546_09 | LCW0402_020 |
| LCW580_06 | ATGGCTAGTCCTGCTGGCTCTCCAACCTC CACTGAGGAAGGTACCCGGGTAGCGGT ACTGCTTCTTCCTCTCCAGGTAGCTCTAC CCCTTCTGGTGCAACCGGCTCTCCAGGTG CTTCTCCGGGCACCAGCTCTACCGGTTCT CCAGGTACTTCTACTGAACCGTCTGAAG GCAGCGCA | 679 | LCW546_06 | LCW0404_031 |
| LCW580_35 | ATGGCTAGTCCTGCTGGCTCTCCGACCTC TACTGAGGAAGGTACTTCTACTGAACCG TCTGAAGGCAGCGCACCAGGTAGCGAAC CGGCTACTTCCGGTTCTGAAACCCCAGGT AGCCCAGCAGGTTCTCCAACTTCTACTGA AGAAGGTACTTCTACTGAACCGTCTGAA GGCAGCGCA | 680 | LCW546_09 | LCW0402_020 |
| LCW580_67 | ATGGCTAGTCCTGCTGGCTCTCCGACCTC TACTGAGGAAGGTACCTCCCCTAGCGGC GAATCTTCTACTGCTCCAGGTACCTCTCC TAGCGGCGAATCTTCTACCGCTCCAGGT ACCTCCCCTAGCGGTGAATCTTCTACCGC ACCAGGTACTTCTACTGAACCGTCTGAA GGCAGCGCA | 681 | LCW546_09 | LCW0403_064 |
| LCW580_13 | ATGGCTAGTCCTGCTGGCTCTCCGACCTC TACTGAGGAAGGTACCTCTACTCCGGAA AGCGGTTCCGCATCTCCAGGTTCTACCAG CGAATCCCGTCTGGCACCGCACCAGGT TCTACTAGCTCTACTGCTGAATCTCCGGG CCCAGGTACTTCTACTGAACCGTCTGAA GGCAGCGCA | 682 | LCW546_09 | LCW0403_060 |
| LCW580_88 | ATGGCTAGTCCTGCTGGCTCTCCGACCTC TACTGAGGAAGGTACCTCCCCTAGCGGC GAATCTTCTACTGCTCCAGGTACCTCTCC TAGCGGCGAATCTTCTACCGCTCCAGGT ACCTCCCCTAGCGGTGAATCTTCTACCGC ACCAGGTACTTCTACTGAACCGTCTGAA GGCAGCGCA | 683 | LCW546_09 | LCW0403_064 |

TABLE 21-continued

Combinatorial 12mer and 36mer Clones Superior to Benchmark Clone

| Clone Name | First 60 codons | SEQ ID NO: | 12mer Name | 36mer Name |
|---|---|---|---|---|
| LCW580_11 | ATGGCTAGTCCTGCTGGCTCTCCGACCTC TACTGAGGAAGGTACCTCTACTCCGGAA AGCGGTTCCGCATCTCCAGGTTCTACCAG CGAATCCCGTCTGGCACCGCACCAGGT TCTACTAGCTCTACTGCTGAATCTCCGGG CCCAGGTACTTCTACTGAACCGTCTGAA GGCAGCGCA | 684 | LCW546_09 | LCW0403_060 |

Example 17

Construction of N-Terminal Extensions of XTEN-Construction and Screening of Combinatorial 12mer and 36mer Libraries for XTEN-AM875 and XTEN-AE864

This example details a step in the optimization of the N-terminus of the XTEN protein to promote the initiation of translation to allow for expression of XTEN fusions at the N-terminus of proteins without the presence of a helper domain. With preferences for the first four codons (see Examples supra, and for the best pairing of N-terminal 12mers and 36mers (see Example supra) established, a combinatorial approach was undertaken to examine the union of these preferences. This created novel 48mers at the N-terminus of the XTEN protein and enabled the testing of the confluence of previous conclusions. Additionally, the ability of these leader sequences to be a universal solution for all XTEN proteins was assessed by placing the new 48mers in front of both XTEN-AE864 and XTEN-AM875. Instead of using all 125 clones of 36mer segment, the plasmids from 6 selected clones of 36mer segment with best GFP expression in the combinatorial library were digested with NdeI/EcoRI/BsaI and the appropriate fragments were gel-purified. The plasmids from clones AC94 (CBD-XTEN_AM875-GFP) and AC104 (CBD-XTEN_AE864-GFP) were digested with digested with NdeI/EcoRI/BsaI and the appropriate fragments were gel-purified. These fragments were ligated together and transformed into E. coli BL21Gold(DE3) competent cells to obtain colonies of the libraries LCW0585 (—XTE-N_AM875-GFP) and LCW0586 (—XTEN_AE864-GFP), which could also serve as the vectors for further cloning 8 selected 12mers at the very N-terminus. The plasmids of LCW0585 and LCW0586 were digested with NdeI/EcoRI/BsaI and the appropriate fragments were gel-purified. 8 pairs of oligonucleotides encoding 8 selected 12mer sequences with best GFP expression in the previous (Generation 2) screening were designed, annealed and ligated with the NdeI/EcoRI/BsaI digested LCW0585 and LCW0586 vectors, and transformed into E. coli BL21Gold(DE3) competent cells to obtain colonies of the final libraries LCW0587 (XTE-N_AM923-GFP) and LCW0588 (XTEN_AE912-GFP). With a theoretical diversity of 48 unique clones, a total of 252 individual colonies from the created libraries were picked and grown overnight to saturation in 500 µl of super broth media in a 96 deep well plate. This provided sufficient coverage to understand relative library performance and sequence preferences. The saturated overnight cultures were used to inoculate new 500 ml cultures in auto-induction media in which were grown overnight at 26° C. These expression cultures were then assayed using a fluorescence plate reader (excitation 395 nm, emission 510 nm) to determine the amount of GFP reporter present. The top 36 clones were sequenced and retested for GFP reporter expression. 36 clones yielded usable sequencing data and these 36 were used for the subsequent analysis. The sequencing data determined the 12mer, the third codon, the fourth codon and the 36mer present in the clone and revealed that many of the clones were independent replicates of the same sequence. Additionally, the retest results for these clones are close in value, indicating the screening process was robust. Preferences for certain combinations at the N-terminus were seen and were consistently yielding higher fluorescence values approximately 50% greater than the benchmark controls (see Tables 22 and 23). These date support the conclusion that the inclusion of the sequences encoding the optimized N-terminal XTEN into the fusion protein genes conferred a marked enhancement on the expression of the fusion proteins.

TABLE 22

Preferred N-terminal Combinations for XTEN-AM875

| Clone Name | Number of Replicates | 12mer | 36mer | Mean | SD | CV |
|---|---|---|---|---|---|---|
| CBD-AM875 | NA | NA | NA | 1715 | 418 | 16% |
| LCW587_08 | 7 | LCW546_06_3 = GAA | LCW404_40 | 2333 | 572 | 18% |
| LCW587_17 | 5 | LCW546_09_3 = GAA | LCW403_64 | 2172 | 293 | 10% |

TABLE 23

Preferred N-terminal Combinations for XTEN-AE864

| Clone Name | Number of Replicates | 12mer | 36mer | Mean | SD | CV |
|---|---|---|---|---|---|---|
| AC82 | NA | NA | NA | 1979 | 679 | 24% |
| LCW588_14 | 8 | LCW546_06_opt3 | LCW404_31 | 2801 | 240 | 6% |
| LCW588_27 | 2 | LCW546_06_opt34 | LCW404_40 | 2839 | 556 | 15% |

Figure 15:
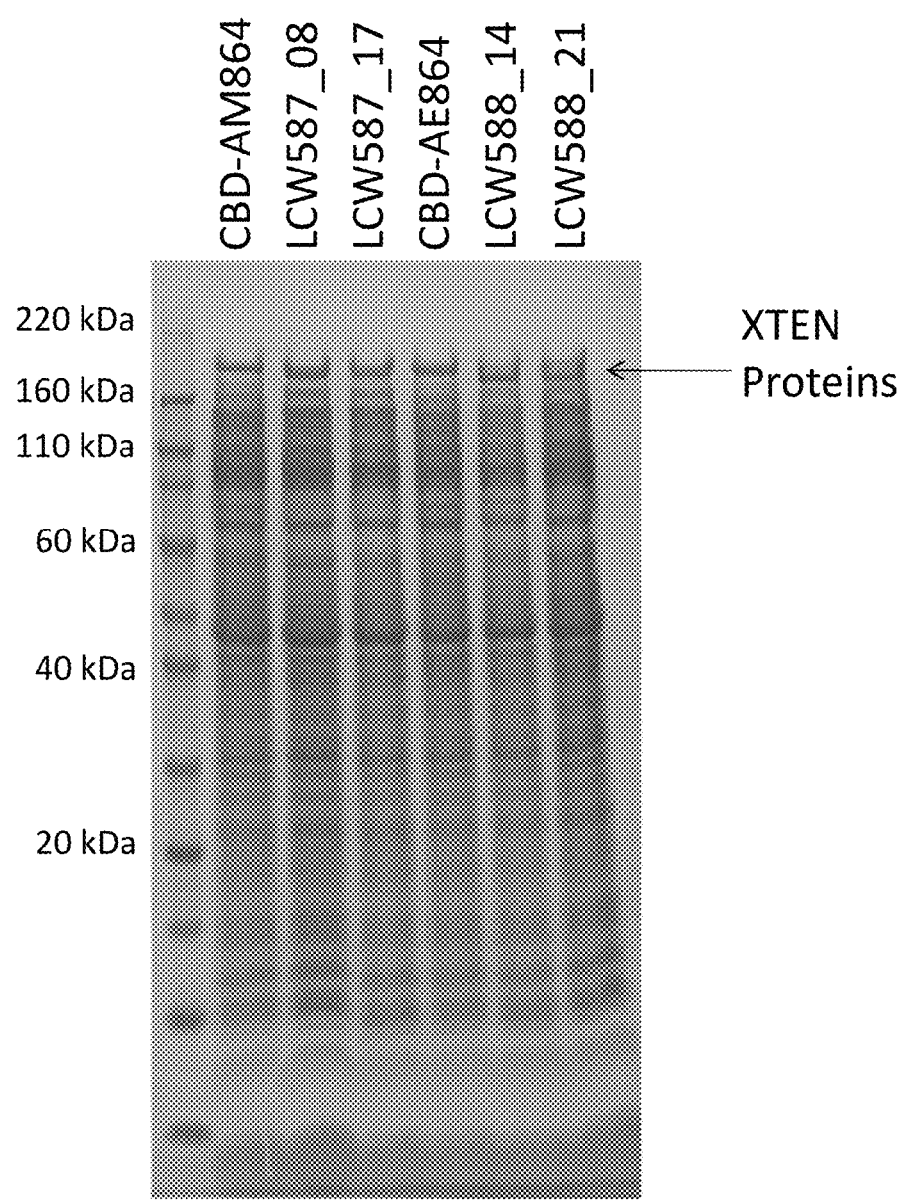
FIG. 15 shows an SDS-PAGE gel confirming expression of preferred clones obtained from the XTEN N-terminal codon optimization experiments, in comparison to benchmark XTEN clones comprising CBD leader sequences at the N-terminus of the construct sequences.

Notably, the preferred combination of the N-terminal for the XTEN-AM875 and the preferred combination for the XTEN-AE864 are not the same (Tables 22 and 23), indicating more complex interactions further than 150 bases from the initiation site influence expression levels. The sequences for the preferred nucleotide sequences are listed in Table 24 and the preferred clones were analyzed by SDS-PAGE to independently confirm expression (see FIG. 15). The complete sequences of XTEN_AM923 and XTEN_AE912 were selected for further analysis.

TABLE 24

Preferred DNA Sequences for first 48 Amino Acid Residues of N-terminal XTEN-AM875 and XTEN-AE864

| Clone Name | XTEN Modified | Nucleotide Sequence | SEQ ID NO: |
|---|---|---|---|
| LCW587_08 | AM875 | ATGGCTGAACCTGCTGGCTCTCCAACCTCCACTGAGGAAGGTGCATC CCCGGGCACCAGCTCTACCGGTTCTCCAGGTAGCTCTACCCCGTCTG GTGCTACCGGCTCTCCAGGTAGCTCTACCCCGTCTGGTGCTACTGGC TCTCCAGGTACTTCTACTGAACCGTCTGAAGGCAGCGCA | 685 |
| LCW587_17 | AM875 | ATGGCTGAACCTGCTGGCTCTCCGACCTCTACTGAGGAAGGTACCTC CCCTAGCGGCGAATCTTCTACTGCTCCAGGTACCTCTCCTAGCGGCG AATCTTCTACCGCTCCAGGTACCTCCCCTAGCGGTGAATCTTCTACC GCACCAGGTACTTCTACTGAACCGTCTGAAGGCAGCGCA | 686 |
| LCW588_14 | AE864 | ATGGCTGAACCTGCTGGCTCTCCAACCTCCACTGAGGAAGGTACCCC GGGTAGCGGTACTGCTTCTTCCTCTCCAGGTAGCTCTACCCCTTCTGG TGCAACCGGCTCTCCAGGTGCTTCTCCGGGCACCAGCTCTACCGGTT CTCCAGGTAGCCCGGCTGGCTCTCCTACCTCTACTGAG | 687 |
| LCW588_27 | AE864 | ATGGCTGAAACTGCTGGCTCTCCAACCTCCACTGAGGAAGGTGCATC CCCGGGCACCAGCTCTACCGGTTCTCCAGGTAGCTCTACCCCGTCTG GTGCTACCGGCTCTCCAGGTAGCTCTACCCCGTCTGGTGCTACTGGC TCTCCAGGTAGCCCGGCTGGCTCTCCTACCTCTACTGAG | 688 |

Example 18

Construction of CTLA4-XTEN Genes and Vectors

The CTLA4 dimer genes encoding CTLA4(1-120)-XTEN_AE42-CTLA4(3-120) and CTLA4(1-125)-XTEN_AE42-CTLA4(3-125) were designed and synthesized by GeneArt, which introduced NdeI and BbsI restriction sites that are compatible with the NdeI and BsaI sites that flank CBD (Cellulose Binding Domain) in the CBD-XTEN destination vector. The CBD-XTEN plasmid is a pET30 derivative from Novagen in the format of CBD-XTEN_AE864, where CBD is the stuffer for cloning. Constructs were generated by replacing CBD in CBD-XTEN vector with the CTLA4 dimers-encoding fragments. The CBD-XTEN plasmid features a T7 promoter upstream of the CBD sequence, and an XTEN_AE864 sequence fused in-frame downstream of the CBD sequence. The stuffer CBD was removed by restriction digestion using NdeI and BsaI endonucleases. Restriction endonucleases NdeI and BbsI digested CTLA4 dimer DNA fragments were ligated into the NdeI and BsaI digested CBD-XTEN vector using T4 DNA ligase and electroporated into BL21-Gold(DE3) (Stratagene). Transformants were screened by DNA miniprep and the desired constructs were confirmed by DNA sequencing. The final plasmids yield the CTLA4 dimers with XTEN_AE42 linker fused to XTEN_AE864 genes under the control of a T7 promoter. The resulting DNA are amino acid sequences are listed below. SEQ ID NO: 182 and 184.

The linker XTEN_AE42 included in the CTLA4 dimers-XTEN_AE864 plasmids was removed by restriction digestion using the flanking AscI and FseI endonucleases. On the other end, XTEN_AE158 sequence with the same flanking AscI and FseI restriction sites constructed on another plasmid was digested with AscI and FseI endonucleases and ligated into the AscI and FseI digested CTLA4 dimers-XTEN_AE864 plasmids above using T4 DNA ligase and electroporated into BL21-Gold(DE3) (Stratagene). Transformants were screened by DNA miniprep and the desired constructs were confirmed by DNA sequencing. The final plasmids yield the CTLA4 dimers with XTEN_AE158 linker fused to XTEN_AE864 genes under the control of a T7 promoter. The resulting DNA and amino acid sequences are presented in Table 25 below.

Example 19

Construction of aIL6R-XTEN Genes and Vectors

DNA ligase and electroporated into BL21-Gold(DE3) (Stratagene). The plasmids yield the aIL6R sscFv-XTE- N_AE864 genes under the control of the T7 promoter. The plasmid with one additional BsaI site introduced by PCR was further digested by NdeI and BsaI, ligated with NdeI and BsaI digested XTEN_AE48 fragment using T4 DNA ligase and electroporated into BL21-Gold (DE3). The final plasmid yields the XTEN_AE48-aIL6R scFv-XTEN_AE864 gene under the control of a T7 promoter. All the transformants were screened by DNA miniprep and the desired constructs were confirmed by DNA sequencing. The resulting DNA sequences and encoded final product are provided below. The genes encoding aIL6R scFv at C-terminus were amplified by PCR, which introduced BsaI/HindIII and BsaI/BbsI&HindIII restriction sites that are compatible with the BbsI and HindIII sites that flank GFP (Green Fluorescent Protein) in the XTEN-GFP destination vector. The XTEN-GFP plasmid is a pET30 derivative from Novagen in the format of XTE-N_AE912-GFP, where GFP is the stuffer for cloning. Constructs were generated by replacing GFP in XTEN-GFP vector with the aIL6R scFv-encoding PCR fragments. The XTEN-GFP plasmid features a T7 promoter upstream of the XTEN_AE912 sequence and a stuffer GFP sequence fused in-frame downstream of the XTEN_AE912 sequence. The stuffer GFP was removed by restriction digestion using BbsI and HindIII endonucleases. Restriction endonucleases BsaI and HindIII digested aIL6R scFv PCR fragments were ligated into the BbsI and HindIII digested XTEN-GFP vector using T4 DNA ligase and electroporated into BL21-Gold(DE3) (Stratagene). The plasmids yield the XTEN_AE912-aIL6R scFv genes under the control of the T7 promoter. The plasmid with one additional BbsI site introduced by PCR was further digested by BbsI and HindIII, ligated with BsaI and HindIII digested XTEN_AE144 fragment using T4 DNA ligase and electroporated into BL21-Gold (DE3). The final plasmid yields the XTEN_AE912-aIL6R scFv-XTEN_AE144 gene under the control of a T7 promoter. All the transformants were screened by DNA miniprep and the desired constructs were confirmed by DNA sequencing. The resulting DNA sequences and encoded amino acid sequences are provided in Table 25 below.

Example 20

Construction anti-CD40-XTEN and XTEN-anti-CD40 Genes and Vectors

Construction anti-CD40-XTEN

Two genes encoding anti-CD40 were designed by reverse-translation combined with codon optimization. These genes encoding anti-CD40 were synthesized by GeneArt (Regensburg, Germany), which introduced NdeI and BbsI restriction sites that are compatible with the NdeI and BsaI sites that flank the stuffer in the pCBD-XTEN_AE864 destination vector. The pCBD-XTEN_AE864 plasmid is a pET30 derivative from Novagen. Constructs were generated by replacing the CBD sequence in pCBD-XTEN_AE864 with the anti-CD40-encoding fragments. The pCBD-XTEN_AE864 features a T7 promoter upstream of CBD followed by an XTEN sequence fused in-frame. Restriction digested anti-CD40 DNA fragments were ligated into the cleaved pCBD-XTEN_AE864 vector using T4 DNA ligase and electroporated into BL21 (DE3) Gold (Stratagene, La Jolla, Calif.). Transformants were screened by DNA miniprep and the desired construct was confirmed by DNA sequencing. The final vectors yield the anti-CD40-XTEN_AE864 gene under the control of a T7 promoter. The resulting constructs are: AC384, pBC0009; AC385, pBC0010. The resulting DNA sequences and encoded amino acid sequences are provided in Table 25 below.

Construction of XTEN-anti-CD40

Two genes encoding anti-CD40 were amplified by polymerase chain reaction (PCR) using primers anti-CD40forBsaI (anti-CD40_1forBsaI ATAAAGGGTCTC-CAGGTGAAATTGTTCTGACCCAATCTCC (SEQ ID NO: 689); anti-CD40_2forBsaI: ATAAAGGGTCTCCAG-GTGAAATTGTTCTGACTCAATCTCCA (SEQ ID NO: 690)) and anti-CD40revHindIII (anti-CD40_1revHindIII: AACTCGAAGCTTttaGCTAGACACAGTAACCAGAGT (SEQ ID NO: 691); anti-CD40_2revHindIII: AACTC-GAAGCTTttaAGAGGATACGGTCACCAGAGT (SEQ ID NO: 692)), which introduced BsaI and HindIII restriction sites that are compatible with the BbsI and HindIII sites that flank the stuffer in the XTEN_AE912 destination vector. The XTEN_AE912-GFP plasmid is a pET30 derivative from Novagen. Constructs were generated by replacing the GFP sequence in XTEN_AE912-GFP with the anti-CD40-encoding fragments. The XTEN_AE912-GFP features a T7 promoter upstream of XTEN followed by a GFP sequence fused in-frame. The GFP fragments were removed by restriction digestion using BbsI and HindIII endonucleases. Restriction digested anti-CD40 DNA fragments were ligated into the cleaved XTEN_AE912-GFP vector using T4 DNA ligase and electroporated into BL21(DE3) Gold (Stratagene, La Jolla, Calif.). Transformants were screened by DNA miniprep and the desired construct was confirmed by DNA sequencing. The final vectors yield the XTEN_AE912-anti-CD40 gene under the control of a T7 promoter. The resulting constructs are: AC386, pBC0011; AC387, pBC0012. The resulting DNA sequences and encoded amino acid sequences are provided below.

Example 21

Construction of anti-Her2-XTEN and XTEN-anti-Her2 Genes and Vectors

Construction of Anti-Her2-XTEN

The gene encoding scFv anti-Her2 has the format VL-XTEN_Y30-VH, where VL is the light chain of anti-Her2 antibody fragment, VH is the heavy chain of the antibody fragment and XTEN_Y30 is the sequence GSGEG-SEGEGGGEGSEGEGSGEGGEGEGSG (SEQ ID NO: 1) flanked by the restriction sites AgeI and KpnI. The gene was synthesized and cloned into a commercial vector for use as the PCR template. The gene encoding scFv anti-Her2 was amplified by polymerase chain reaction (PCR) using primers anti-Her2for NdeI (agatatacatATGGAAGACATTCAGAT-GACCCAGAGC (SEQ ID NO: 693)) and anti-Her2revBsaI (CCGGGCTACCTGGAGACCCGGAAACAGT-TACCAGAGTACC (SEQ ID NO: 694)), which introduced NdeI and BsaI restriction sites that are compatible with the NdeI and BsaI sites that flank the stuffer in the pCBD-XTE-N_AE864 destination vector. The pCBD-XTEN_AE864 plasmid is a pET30 derivative from Novagen. Constructs were generated by replacing the CBD sequence in pCBD-XTEN_AE864 with the anti-Her2-encoding fragments. The pCBD-XTEN_AE864 features a T7 promoter upstream of CBD followed by an XTEN sequence fused in-frame. Restriction digested anti-Her2 DNA fragments were ligated into the cleaved pCBD-XTEN_AE864 vector using T4 DNA ligase and electroporated into BL21(DE3) Gold (Stratagene, La Jolla, Calif.). Transformants were screened by DNA miniprep and the desired construct was confirmed by DNA sequencing. The final vectors yield the anti-Her2-XTEN_AE864 gene under the control of a T7 promoter. The resulting constructs isare: pBC0007, SeqID 140. The resulting DNA sequences and encoded amino acid sequences are provided below.

Construction of XTEN-anti-Her2

The gene encoding svFV anti-Her2 (described above) was amplified by polymerase chain reaction (PCR) using primers anti-Her2forBbsI (GCACCAGGTTCGTCTTCACTCGA-CATTCAGATGACCCAGAGC (SEQ ID NO: 695)) and anti-Her2revHindIII (AACTCGAAGCTTTCAGGAAA-CAGTTACCAGAGTACCTTG (SEQ ID NO: 696)), which introduced BbsI and HindIII restriction sites that are compatible with the BbsI and HindIII sites that flank the stuffer in the XTEN_AE912 destination vector. The XTEN_AE912-GFP plasmid is a pET30 derivative from Novagen. Constructs were generated by replacing the GFP sequence in XTEN_AE912-GFP with the anti-Her2-encoding fragment. The XTEN_AE912-GFP features a T7 promoter upstream of XTEN followed by a GFP sequence fused in-frame. The GFP fragment was removed by restriction digestion using BbsI and HindIII endonucleases. Restriction digested anti-Her2 DNA fragment was ligated into the cleaved XTEN_AE912-GFP vector using T4 DNA ligase and electroporated into BL21(DE3) Gold (Stratagene, La Jolla, Calif.). Transformants were screened by DNA miniprep and the desired construct was confirmed by DNA sequencing. The final vectors yield the XTEN_AE912-anti-Her2 gene under the control of a T7 promoter. The resulting constructs is: pBC0008. The resulting DNA sequences and encoded final product are provided in Table 25 below.

Example 22

Construction of Anti-EGFR-XTEN Genes and Vectors

The gene encoding anti-EGFR was amplified by polymerase chain reaction (PCR) from a library, which introduced NdeI and BbsI restriction sites that are compatible with the NdeI and BsaI sites that flank the first FLAG tag in the FLAG-Y50-FLAG-His6 ("His6" disclosed as SEQ ID NO: 218) destination vector. Constructs were generated by replacing the FLAG sequence in FLAG-Y50-FLAG-His6 ("His6" disclosed as SEQ ID NO: 218) with the anti-EGFR-encoding fragments. The FLAG-Y50-FLAG-His6 ("His6" disclosed as SEQ ID NO: 218) features a T7 promoter upstream of FLAG followed by the Y50-FLAG-His6 ("His6" disclosed as SEQ ID NO: 218) sequence fused in-frame. Restriction digested anti-EGFR DNA fragments were ligated into the cleaved FLAG-Y50-FLAG-His6 ("His6" disclosed as SEQ ID NO: 218) vector using T4 DNA ligase and electroporated into XL1 Blue. Transformants were screened by DNA miniprep and the desired constructs were confirmed by DNA sequencing. The final vectors yield the anti-EGFR—Y50-FLAG-His6 ("His6" disclosed as SEQ ID NO: 218) gene under the control of a T7 promoter. The resulting construct is: pMS0120. The resulting DNA sequences and encoded amino acid sequences are provided in Table 25 below.

Example 23

Construction Anti-CD3-XTEN Genes and Vectors

The gene encoding anti-CD3 was amplified by polymerase chain reaction (PCR) from a library, which introduced NdeI and BbsI restriction sites that are compatible with the NdeI and BsaI sites that flank the stuffer in the stuffer-Y288-GFP-His8 ("His8" disclosed as SEQ ID NO: 697) destination vector. Constructs were generated by replacing the stuffer sequence in the stuffer-Y288-GFP-His8 ("His8" disclosed as SEQ ID NO: 697) with the anti-CD3-encoding fragments. Restriction digested anti-CD3 DNA fragments were ligated into the stuffer-Y288-GFP-His8 ("His8" disclosed as SEQ ID NO: 697) vector using T4 DNA ligase and electroporated into BL21(DE3) Gold (Stratagene, La Jolla, Calif.). Transformants were screened by DNA miniprep and the desired constructs were confirmed by DNA sequencing. The final vectors yield the anti-CD3-Y288-GFP-His gene under the control of a T7 promoter. The resulting construct is: pMS0185. The resulting DNA sequences and encoded amino acid sequences are provided below.

Example 24

Construction of Genes and Vectors Comprising Multiple scFv

Construction of the Anti-Her2-Y288-Anti-CD3-HA-His6 ("His6" Disclosed as SEQ ID NO: 218) AND Anti-Her2-Y288-Anti-EGFR-HA-His6 ("His6" Disclosed as SEQ ID NO: 218) Genes and Vectors The genes encoding anti-CD3 and anti-EGFR were amplified by polymerase chain reaction (PCR), which introduced BbsI restriction sites on both ends of the DNA fragments. A polymerase chain reaction (PCR) was performed to introduce an HA-His6 ("His6" disclosed as SEQ ID NO: 218) tag with a HindIII restriction site on the 3' end. The anti-CD3-HA-His6 ("His6" disclosed as SEQ ID NO: 218) (or the anti-EGFR-HA-His6 ("His6" disclosed as SEQ ID NO: 218)) fragments were compatible with the BbsI and HindIII sites that flank the GFP-His8 in the anti-Her2-Y288-GFP-His8 ("His8" disclosed as SEQ ID NO: 697) destination vector. Constructs were generated by replacing the GFP-His8 ("His8" disclosed as SEQ ID NO: 697) sequence in the anti-Her2-Y288-GFP-His8 ("His8" disclosed as SEQ ID NO: 697) with the anti-CD3-HA-His6 ("His6" disclosed as SEQ ID NO: 218) or anti-EGFR-HA-His6-encoding fragments ("His6" disclosed as SEQ ID NO: 218). Restriction digested anti-CD3-HA-His6 ("His6" disclosed as SEQ ID NO: 218) or anti-EGFR-HA-His6 ("His6" disclosed as SEQ ID NO: 218) DNA fragments were ligated into the anti-Her2-Y288-GFP-His8 ("His8" disclosed as SEQ ID NO: 697) vector using T4 DNA ligase and electroporated into BL21(DE3) Gold (Stratagene, La Jolla, Calif.). Transformants were screened by DNA miniprep and the desired constructs were confirmed by DNA sequencing. The final vectors yield the anti-Her2-Y288-anti-CD3-HA-His6 ("His6" disclosed as SEQ ID NO: 218) and anti-Her2-Y288-anti-EGFR-HA-His6 ("His6" disclosed as SEQ ID NO: 218) gene under the control of a T7 promoter. The resulting constructs are: pMS0183, AC48 and pMS0184, AC49. The resulting DNA sequences and encoded final product are provided in Table 25 below.

Construction of the Anti-Her2-Y288-Anti-CD3-HA-His8 ("His8" Disclosed as SEQ ID NO: 697) Genes and Vectors The gene encoding anti-CD3 was amplified by polymerase chain reaction (PCR), which introduced BbsI and SpeI restriction sites that are compatible with the BbsI and SpeI sites that flank the GFP in the anti-Her2-Y288-GFP-HA-His8 ("His8" disclosed as SEQ ID NO: 697) destination vector. Constructs were generated by replacing the GFP sequence in the anti-Her2-Y288-GFP-HA-His8 ("His8" disclosed as SEQ ID NO: 697) with the anti-CD3-encoding fragments. Restriction digested anti-CD3 or DNA fragments were ligated into the anti-Her2-Y288-GFP-HA-His8 ("His8" disclosed as SEQ ID NO: 697) vector using T4 DNA ligase and electroporated into XL1 Blue. Transformants were screened by DNA miniprep and the desired constructs were confirmed by DNA sequencing. The final vectors yield the anti-Her2-Y288-anti-CD3-HA-His8 ("His8" disclosed as SEQ ID NO: 697) gene under the control of a T7 promoter. The resulting construct is: pMS0212, AC69. The resulting DNA sequences and encoded amino acid sequences are provided in Table 25 below.

Example 25

Construction of Multivalent aEGFR VHH Binders

A library LCW0501 of EGFR_VHH-XTEN_AM144 was constructed by using PCR on four clones of previously codon-optimized library LMS109.005, 020, 038 & 045 with amino acid and DNA sequences designated NdeI_BsaI-EGFR_VHH1-XTEN_AM144-GFP6~229-H8 (LMS109.005); NdeI_BsaI-EGFR_VHH1-XTEN_AM144-GFP6~229-H8 (LMS109.020); NdeI_BsaI-EGFR_VHH1-XTEN_AM144-GFP6~229-H8) (LMS109.038); and NdeI_BsaI-EGFR_VHH1-XTEN_AM144-GFP6~229-H8 (LMS109.045). The amino acid and nucleic acid sequences are provided below. LCW0501 has the gene library of EGFR_VHH-XTEN_AM144 with the flanking restriction sites NdeI&BsaI and BbsI, fused to GFP-8×His-tag ("8×His" disclosed as SEQ ID NO: 697) on a vector of pET30 derivative from Novagen.

The plasmid of LCW0501 was digested with BsaI/HindIII to generate the small fragment as the insert and digested with BbsI/HindIII to generate the large fragment as the vector. The insert and vector fragments were ligated and the ligation mixture was electroporated into BL21-Gold (DE3) cells to obtain transformants of LCW0502. LCW0502 is the gene library of EGFR_VHH-XTEN_AM144 dimer with the same flanking restriction sites BsaI and BbsI fused to GFP-8×His-tag ("8×His" disclosed as SEQ ID NO: 697) on the same vector.

The plasmid of LCW0502 was digested with BsaI/HindIII to generate the small fragment as the insert and digested with BbsI/HindIII to generate the large fragment as the vector. The insert and vector fragments were ligated and the ligation mixture was electroporated into BL21-Gold (DE3) cells to obtain transformants of LCW0503. LCW0503 is the gene library of EGFR_VHH-XTEN_AM144 tetramer with the same flanking restriction sites BsaI and BbsI fused to GFP-8×His-tag ("8×His" disclosed as SEQ ID NO: 697) on the same vector.

The plasmid of LCW0502 was digested with BsaI/HindIII to generate the small fragment as the insert and the plasmid of LCW0503 was digested with BbsI/HindIII to generate the large fragment as the vector. The insert and vector fragments were ligated and the ligation mixture was electroporated into BL21-Gold (DE3) cells to obtain transformants of LCW0504. LCW0504 is the gene library of EGFR_VHH-XTEN_AM144 hexamer with the same flanking restriction sites BsaI and BbsI fused to GFP-8×His-tag ("8×His" disclosed as SEQ ID NO: 697) on the same vector.

The plasmid of LCW0503 was digested with BsaI/HindIII to generate the small fragment as the insert and digested with BbsI/HindIII to generate the large fragment as the vector. The insert and vector fragments were ligated and the ligation mixture was electroporated into BL21-Gold (DE3) cells to obtain transformants of LCW0505. LCW0505 is the gene library of EGFR_VHH-XTEN_AM144 octamer with the same flanking restriction sites BsaI and BbsI fused to GFP-8×His-tag ("8×His" disclosed as SEQ ID NO: 697) on the same vector.

The LCW501, LCW502, LCW503, LCW504 and LCW505 libraries were screened to determine the best expression candidate for evaluation. The screen was conducted as follows for all of the libraries. Colonies a transformation were picked into 500 µl cultures of LB in 96 deep well plates and grown to saturation overnight. These cultures were stored at 4° C. after 40 µl of these cultures was used to inoculate 500 µl of auto-induction media and these cultures were grown at 26° C. for >24 hours. Following the growth the GFP fluorescence of 100 µl of these auto-induction media cultures was measured using a fluorescence plate reader. The GFP fluorescence is proportional to protein expression and is therefore a read out of total expression. The highest expressing clones were identified, and a new 1 ml overnight was started in SB from the original saturated overnight of that clone. Mini-preps were performed with these new cultures to derived plasmids. The DNA and amino acid sequences are provided in Table 25 below.

TABLE 25

DNA and amino acid sequences of binding fusion protein constructs

| Clone Name | DNA Sequence | SEQ ID NO: | Amino Acid Sequence | SEQ ID NO: |
|---|---|---|---|---|
| CTLA4-AE36-CTLA4-AE864, AC389 | ATGGCAATGCATGTTGCACAGCCTGCAGTTGTTCTGGC AAGCAGCCGTGGTATTGCCAGCTTTGTTTGTGAATATGC AAGTCCGGGTAAAGCAACCGAAGTTCGTGTTACCGTTC TGAGACAGGCAGATAGCCAGGTTACCGAAGTTTGTGCA GCAACCTATATGATGGGTAATGAACTGACCTTTCTGGA TGATAGCATTTGTACCGGCACCAGCAGCGGTAATCAGG TTAATCTGACCATTCAGGGTCTGCGTGCAATGGATACC GGTCTGTATATTTGTAAAGTGGAACTGATGTATCCGCCT CCGTATTATCTGGGTATTGGTAATGGCACCCAGATTTAT GTTATTGATCCGGAAGGCGCGCCAGGTACAAGCGAAAG CGCAACACCGGAAAGCGGTCCGGGTAGCGAACCGGCA ACCAGCGGTAGCGAAACACCGGGTACATCAACCGAAC CGAGCGAAGGTAGCGCACCGGGGCCGGCCATGCATGT GGCCCAGCCAGCCGTGGTGCTGGCAAGTTCACGCGGTA TTGCATCATTTGTGTGCGAATATGCATCACCTGGTAAAG CCACAGAAGTGCGCGTAACAGTACTGCGTCAGGCCGAT TCACAGGTGACAGAAGTTTGCGCTGCCACATACATGAT GGGCAACGAGCTGACATTCCTGGACGATTCAATTTGTA | 698 | MAMHVAQPAVV LASSRGIASFVCE YASPGKATEVRV TVLRQADSQVTE VCAATYMMGNE LTFLDDSICTGTS SGNQVNLTIQGL RAMDTGLYICKV ELMYPPPYYLGIG NGTQIYVIDPEGA PGTSESATPESGP GSEPATSGSETPG TSTEPSEGSAPGP AMHVAQPAVVL ASSRGIASFVCEY ASPGKATEVRVT VLRQADSQVTEV CAATYMMGNEL | 723 |

TABLE 25-continued

DNA and amino acid sequences of binding fusion protein constructs

| Clone Name | DNA Sequence | SEQ ID NO: Amino Acid Sequence | SEQ ID NO: |
|---|---|---|---|
| | CTGGTACAAGCTCAGGCAATCAGGTGAACCTGACAATC | TFLDDSICTGTSS | |
| | CAAGGCCTGAGAGCTATGGACACAGGCCTGTACATCTG | GNQVNLTIQGLR | |
| | CAAAGTTGAGCTGATGTACCCTCCGCCTTATTACTTAGG | AMDTGLYICKVE | |
| | CATTGGCAACGGTACACAGATCTATGTGATCGATCCTG | LMYPPPYYLGIG | |
| | AGGGAGGTAGCCCGGCTGGCTCTCCTACCTCTACTGAG | NGTQIYVIDPEGG | |
| | GAAGGTACTTCTGAAAGCGCTACTCCTGAGTCTGGTCC | SPAGSPTSTEEGT | |
| | AGGTACCTCTACTGAACCGTCCGAAGGTAGCGCTCCAG | SESATPESGPGTS | |
| | GTAGCCCAGCAGGCTCTCCGACTTCCACTGAGGAAGGT | TEPSEGSAPGSPA | |
| | ACTTCTACTGAACCTTCCGAAGGCAGCGCACCAGGTAC | GSPTSTEEGTSTE | |
| | CTCTACTGAACCTTCTGAGGGCAGCGCTCCAGGTACTTC | PSEGSAPGTSTEP | |
| | TGAAAGCGCTACCCCGGAATCTGGCCCAGGTAGCGAAC | SEGSAPGTSESAT | |
| | CGGCTACTTCTGGTTCTGAAACCCCAGGTAGCGAACCG | PESGPGSEPATSG | |
| | GCTACCTCCGGTTCTGAAACTCCAGGTAGCCCGGCAGG | SETPGSEPATSGS | |
| | CTCTCCGACCTCTACTGAGGAAGGTACTTCTGAAAGCG | ETPGSPAGSPTST | |
| | CAACCCCGGAGTCCGGCCCAGGTACCTCTACCGAACCG | EEGTSESATPESG | |
| | TCTGAGGGCAGCGCACCAGGTACTTCTACCGAACCGTC | PGTSTEPSEGSAP | |
| | CGAGGGTAGCGCACCAGGTAGCCCAGCAGGTTCTCCTA | GTSTEPSEGSAPG | |
| | CCTCCACCGAGGAAGGTACTTCTACCGAACCGTCCGAG | SPAGSPTSTEEGT | |
| | GGTAGCGCACCAGGTACCTCTACTGAACCTTCTGAGGG | STEPSEGSAPGTS | |
| | CAGCGCTCCAGGTACTTCTGAAAGCGCTACCCCGGAGT | TEPSEGSAPGTSE | |
| | CCGGTCCAGGTACTTCTACTGAACCGTCCGAAGGTAGC | SATPESGPGTSTE | |
| | GCACCAGGTACTTCTGAAAGCGCAACCCCTGAATCCGG | PSEGSAPGTSESA | |
| | TCCAGGTAGCGAACCGGCTACTTCTGGCTCTGAGATC | TPESGPGSEPATS | |
| | CAGGTACTTCTACCGAACCGTCCGAAGGTAGCGCACCA | GSETPGTSTEPSE | |
| | GGTACTTCTACTGAACCGTCTGAAGGTAGCGCACCAGG | GSAPGTSTEPSEG | |
| | TACTTCTGAAAGCGCAACCCCGGAATCCGGCCCAGGTA | SAPGTSESATPES | |
| | CCTCTGAAAGCGCAACCCCGGAGTCCGGCCCAGGTAGC | GPGTSESATPESG | |
| | CCTGCTGGCTCTCCAACCTCCACCGAAGAAGGTACCTC | PGSPAGSPTSTEE | |
| | TGAAAGCGCAACCCCTGAATCCGGCCCAGGTAGCGAAC | GTSESATPESGPG | |
| | CGGCAACCTCCGGTTCTGAAACCCCAGGTACCTCTGAA | SEPATSGSETPGT | |
| | AGCGCTACTCCGGAGTCTGGCCCAGGTACCTCTACTGA | SESATPESGPGTS | |
| | ACCGTCTGAGGGTAGCGCTCCAGGTACTTCTACTGAAC | TEPSEGSAPGTST | |
| | CGTCCGAAGGTAGCGCACCAGGTACTTCTACCGAACCG | EPSEGSAPGTSTE | |
| | TCCGAAGGCAGCGCTCCAGGTACCTCTACTGAACCTTC | PSEGSAPGTSTEP | |
| | CGAGGGCAGCGCTCCAGGTACCTCTACCGAACCTTCTG | SEGSAPGTSTEPS | |
| | AAGGTAGCGCACCAGGTACTTCTACCGAACCGTCCGAG | EGSAPGTSTEPSE | |
| | GGTAGCGCACCAGGTAGCCCAGCAGGTTCTCCTACCTC | GSAPGSPAGSPTS | |
| | CACCGAGGAAGGTACTTCTACCGAACCGTCCGAGGGTA | TEEGTSTEPSEGS | |
| | GCGCACCAGGTACCTCTGAAAGCGCAACTCCTGAGTCT | APGTSESATPESG | |
| | GGCCCAGGTAGCGAACCTGCTACCTCCGGCTCTGAGAC | PGSEPATSGSETP | |
| | TCCAGGTACCTCTGAAAGCGCAACCCCGGAATCTGGTC | GTSESATPESGPG | |
| | CAGGTAGCGAACCTGCAACCTCTGGCTCTGAAACCCCA | SEPATSGSETPGT | |
| | GGTACCTCTGAAAGCGCTACTCCTGAATCTGGCCCAGG | SESATPESGPGTS | |
| | TACTTCTACTGAACCGTCCGAGGGCAGCGCACCAGGTA | TEPSEGSAPGTSE | |
| | CTTCTGAAAGCGCTACTCCTGAGTCCGGCCCAGGTAGC | SATPESGPGSPAG | |
| | CCGGCTGGCTCTCCGACTTCCACCGAGGAAGGTAGCCC | SPTSTEEGSPAGS | |
| | GGCTGGCTCTCCAACTTCTACTGAAGAAGGTAGCCCGG | PTSTEEGSPAGSP | |
| | CAGGCTCTCCGACCTCTACTGAGGAAGGTACTTCTGAA | TSTEEGTSESATP | |
| | AGCGCAACCCCGGAGTCCGGCCCAGGTACCTCTACCGA | ESGPGTSTEPSEG | |
| | ACCGTCTGAGGGCAGCGCACCAGGTACCTCTGAAAGCG | SAPGTSESATPES | |
| | CAACTCCTGAGTCTGGCCCAGGTAGCGAACCTGCTACC | GPGSEPATSGSET | |
| | TCCGGCTCTGAGACTCCAGGTACCTCTGAAAGCGCAAC | PGTSESATPESGP | |
| | CCCGGAATCTGGTCCAGGTAGCGAACCTGCAACCTCTG | GSEPATSGSETPG | |
| | GCTCTGAAACCCCAGGTACCTCTGAAAGCGCTACTCCT | TSESATPESGPGT | |
| | GAATCTGGCCCAGGTACTTCTACTGAACCGTCCGAGGG | STEPSEGSAPGSP | |
| | CAGCGCACCAGGTAGCCCTGCTGGCTCTCCAACCTCCA | AGSPTSTEEGTSE | |
| | CCGAAGAAGGTACCTCTGAAAGCGCAACCCCTGAATCC | SATPESGPGSEPA | |
| | GGCCCAGGTAGCGAACCGGCAACCTCCGGTTCTGAAAC | TSGSETPGTSESA | |
| | CCCAGGTACTTCTGAAAGCGCTACTCCTGAGTCCGGCC | TPESGPGSPAGSP | |
| | CAGGTAGCCCGGCTGGCTCTCCGACTTCCACCGAGGAA | TSTEEGSPAGSPT | |
| | GGTAGCCCGGCTGGCTCTCCAACTTCTACTGAAGAAGG | STEEGTSTEPSEG | |
| | TACTTCTACCGAACCTTCCGAGGGCAGCGCACCAGGTA | SAPGTSESATPES | |
| | CTTCTGAAAGCGCTACCCCTGAGTCCGGCCCAGGTACT | GPGTSESATPESG | |
| | TCTGAAAGCGCTACTCCTGAATCCGGTCCAGGTACTTCT | PGTSESATPESGP | |
| | GAAAGCGCTACCCCGGAATCTGGCCCAGGTAGCGAACC | GSEPATSGSETPG | |
| | GGCTACTTCTGGTTCTGAAACCCCAGGTAGCGAACCGG | SEPATSGSETPGS | |
| | CTACCTCCGGTTCTGAAACTCCAGGTAGCCCAGCAGGC | PAGSPTSTEEGTS | |
| | TCTCCGACTTCCACTGAGGAAGGTACTTCTACTGAACCT | TEPSEGSAPGTST | |
| | TCCGAAGGCAGCGCACCAGGTACCTCTACCGAACCTTC | EPSEGSAPGSEPA | |
| | TGAGGGCAGCGCTCCAGGTAGCGAACCTGCAACCTCTG | TSGSETPGTSESA | |
| | GCTCTGAAACCCCAGGTACCTCTGAAAGCGCTACTCCT | TPESGPGTSTEPS | |
| | GAATCTGGCCCAGGTACTTCTACTGAACCGTCCGAGGG | EGSAPG | |
| | CAGCGCACCAGGTTAA | | |

TABLE 25-continued

DNA and amino acid sequences of binding fusion protein constructs

| Clone Name | DNA Sequence | SEQ ID NO: | Amino Acid Sequence | SEQ ID NO: |
|---|---|---|---|---|
| CTLA4-AE36-CTLA4-AE864, AC390 | ATGGCAATGCATGTTGCACAGCCTGCAGTTGTTCTGGC AAGCAGCCGTGGTATTGCCAGCTTTGTTTGTGAATATGC AAGTCCGGGTAAAGCAACCGAAGTTCGTGTTACCGTTC TGAGACAGGCAGATAGCCAGGTTACCGAAGTTTGTGCA GCAACCTATATGATGGGTAATGAACTGACCTTTCTGGA TGATAGCATTTGTACCGGCACCAGCAGCGGTAATCAGG TTAATCTGACCATTCAGGGTCTGCGTGCAATGGATACC GGTCTGTATATTTGTAAAGTGGAACTGATGTATCCGCCT CCGTATTATCTGGGTATTGGTAATGGCACCCAGATTTAT GTTATTGATCCGGAACCGTGTCCGGATAGCGGCGCGCC AGGTACAAGCGAAAGCGCAACACCGGAAAGCGGTCCG GGTAGCGAACCGGCAACCAGCGGTAGCGAAACACCGG GTACATCAACCGAACCGAGCGAAGGTAGCGCACCGGG GCCGGCCATGCATGTGGCCCAGCCAGCCGTGGTGCTGG CAAGTTCACGCGGTATTGCATCATTTGTGTGCGAATATG CATCACCTGGTAAAGCCACAGAAGTGCGCGTAACAGTA CTGCGTCAGGCCGATTCACAGGTGACAGAAGTTTGCGC TGCCACATACATGATGGGCAACGAGCTGACATTCCTGG ACGATTCAATTTGTACTGGTACAAGCTCAGGCAATCAG GTGAACCTGACAATCCAAGGCCTGAGAGCTATGGACAC AGGCCTGTACATCTGCAAAGTTGAGCTGATGTACCCTC CGCCTTATTACTTAGGCATTGGCAACGGTACACAGATC TATGTGATCGATCCTGAACCTTGCCCTGATTCAGGAGGT AGCCCGGCTGGCTCTCCTACCTCTACTGAGGAAGGTAC TTCTGAAAGCGCTACTCCTGAGTCTGGTCCAGGTACCTC TACTGAACCGTCCGAAGGTAGCGCTCCAGGTAGCCCAG CAGGCTCTCGACTTCCACTGAGGAAGGTACTTCTACT GAACCTTCCGAAGGCAGCGCACCAGGTACCTCTACTGA ACCTTCTGAGGGCAGCGCTCCAGGTACTTCTGAAAGCG CTACCCCGGAATCTGGCCCAGGTAGCGAACCGGCTACT TCTGGTTCTGAAACCCCAGGTAGCGAACCGGCTACCTC CGGTTCTGAAACTCCAGGTAGCCCGGCAGGCTCTCCGA CCTCTACTGAGGAAGGTACTTCTGAAAGCGCAACCCCG GAGTCCGGCCCAGGTACCTCTACCGAACCGTCTGAGGG CAGCGCACCAGGTACTTCTACCGAACCGTCCGAGGGTA GCGCACCAGGTAGCCCAGGTTCTCCTACCTCCACC GAGGAAGGTACTTCTACCGAACCGTCCGAGGGTAGCGC ACCAGGTACCTCTACTGAACCTTCTGAGGGCAGCGCTC CAGGTACTTCTGAAAGCGCTACCCCGGAGTCCGGTCCA GGTACTTCTACTGAACCGTCCGAAGGTAGCGCACCGAGG TACTTCTGAAAGCGCAACCCCTGAATCCGGTCCAGGTA GCGAACCGGCTACTTCTGGCTCTGAGACTCCAGGTACT TCTACCGAACCGTCCGAAGGTAGCGCACCAGGTACTTC TACTGAACCGTCTGAAGGTAGCGCACCAGGTACTTCTG AAAGCGCAACCCCGGAATCCGGCCCAGGTACCTCTGAA AGCGCAACCCCGGAGTCCGGCCCAGGTAGCCCTGCTGG CTCTCCAACCTCCACCGAAGAAGGTACCTCTGAAAGCG CAACCCCTGAATCCGGCCCAGGTAGCGAACCGGCAACC TCCGGTTCTGAAACCCCAGGTACCTCTGAAAGCGCTAC TCCGGAGTCTGGCCCAGGTACCTCTACTGAACCGTCTG AGGGTAGCGCTCCAGGTACTTCTACTGAACCGTCCGAA GGTAGCGCACCAGGTACTTCTACCGAACCGTCCGAGGG CAGCGCTCCAGGTACCTCTACTGAACCTTCCGAGGGCA GCGCTCCAGGTACCTCTACCGAACCTTCTGAAGGTAGC GCACCAGGTACTTCTACCGAACCGTCCGAGGGTAGCGC ACCAGGTAGCCCAGCAGGTTCTCCTACCTCCACCGAGG AAGGTACTTCTACCGAACCGTCCGAGGGTAGCGCACCA GGTACCTCTGAAAGCGCAACTCCTGAGTCTGGCCCAGG TAGCGAACCTGCTACCTCCGGCTCTGAGACTCCAGGTA CCTCTGAAAGCGCAACCCCGGAATCTGGTCCAGGTAGC GAACCTGCAACCTCTGGCTCTGAA ACCCCAGGTACCTCTGAAAGCGCTACTCCTGAATCTGG CCCAGGTACTTCTACTGAACCGTCCGAGGGCAGCGCAC | 699 | MAMHVAQPAVV LASSRGIASFVCE YASPGKATEVRV TVLRQADSQVTE VCAATYMMGNE LTFLDDSICTGTS SGNQVNLTIQGL RAMDTGLYICKV ELMYPPPYYLGIG NGTQIYVIDPEPC PDSGAPGTSESAT PESGPGSEPATSG SETPGSTSEPSEG SAPGPAMHVAQP AVVLASSRGIASF VCEYASPGKATE VRVTVLRQADSQ VTEVCAATYMM GNELTFLDDSICT GTSSGNQVNLTIQ GLRAMDTGLYIC KVELMYPPPYYL GIGNGTQIYVIDP EPCPDSGGSPAGS PTSTEEGTSESAT PESGPGTSTEPSE GSAPGSPAGSPTS TEEGTSTEPSEGS APGTSTEPSEGSA PGTSESATPESGP GSEPATSGSETPG SEPATSGSETPGS PAGSPTSTEEGTS ESATPESGPGTST EPSEGSAPGTSTE PSEGSAPGSPAGS PTSTEEGTSTEPS EGSAPGTSTEPSE GSAPGTSESATPE SGPGTSTEPSEGS APGTSESATPESG PGSEPATSGSETP GTSTEPSEGSAPG TSTEPSEGSAPGT SESATPESGPGTS ESATPESGPGSPA GSPTSTEEGTSES ATPESGPGSEPAT SGSETPGTSESAT PESGPGTSTEPSE GSAPGTSESATPE SGPGSPAGSPTST EEGSPAGSPTSTE EGSPAGSPTSTEE GTSESATPESGPG TSTEPSEGSAPGT SESATPESGPGSE PATSGSETPGTSE SATPESGPGSEPA TSGSETPGTSESA TPESGPGTSTEPS EGSAPGSPAGSPT | 724 |

TABLE 25-continued

DNA and amino acid sequences of binding fusion protein constructs

| Clone Name | DNA Sequence | SEQ ID NO: | Amino Acid Sequence | SEQ ID NO: |
|---|---|---|---|---|
| | CAGGTAGCCCTGCTGGCTCTCCAACCTCCACCGAAGAA GGTACCTCTGAAAGCGCAACCCCTGAATCCGGCCCAGG TAGCGAACCGGCAACCTCCGGTTCTGAAACCCCAGGTA CTTCTGAAAGCGCTACTCCTGAGTCCGGCCCAGGTAGC CCGGCTGGCTCTCCGACTTCCACCGAGGAAGGTAGCCC GGCTGGCTCTCCAACTTCTACTGAAGAAGGTACTTCTAC CGAACCTTCCGAGGGCAGCGCACCAGGTACTTCTGAAA GCGCTACCCCTGAGTCCGGCCCAGGTACTTCTGAAAGC GCTACTCCTGAATCCGGTCCAGGTACTTCTGAAAGCGC TACCCCGGAATCTGGCCCAGGTAGCGAACCGGCTACTT CTGGTTCTGAAACCCAGGTAGCGAACCGGCTACCTCC GGTTCTGAAACTCCAGGTAGCCCAGCAGGCTCTCCGAC TTCCACTGAGGAAGGTACTTCTACTGAACCTTCCGAAG GCAGCGCACCAGGTACCTCTACTGAACCTTCTGAGGGC AGCGCTCCAGGTAGCGAACCTGCAACCTCTGGCTCTGA AACCCCAGGTACCTCTGAAAGCGCTACTCCTGAATCTG GCCCAGGTACTTCTACTGAACCGTCCGAGGGCAGCGCA CCAGGTTAA | | STEEGTSESATPE SGPGSEPATSGSE TPGTSESATPESG PGSPAGSPTSTEE GSPAGSPTSTEEG TSTEPSEGSAPGT SESATPESGPGTS ESATPESGPGTSE SATPESGPGSEPA TSGSETPGSEPAT SGSETPGSPAGSP TSTEEGTSTEPSE GSAPGTSTEPSEG SAPGSEPATSGSE TPGTSESATPESG PGTSTEPSEGSAP G | |
| CTLA4- AE158- CTLA4- AE864, AC391 | ATGGCAATGCATGTTGCACAGCCTGCAGTTGTTCTGGC AAGCAGCCGTGGTATTGCCAGCTTTGTTTGTGAATATGC AAGTCCGGGTAAAGCAACCGAAGTTCGTGTTACCGTTC TGAGACAGGCAGATAGCCAGGTTACCGAAGTTTGTGCA GCAACCTATATGATGGGTAATGAACTGACCTTTCTGGA TGATAGCATTTGTACCGGCACCAGCAGCGGTAATCAGG TTAATCTGACCATTCAGGGTCTGCGTGCAATGGATACC GGTCTGTATATTTGTAAAGTGGAACTGATGTATCCGCCT CCGTATTATCTGGGTATTGGTAATGGCACCCAGATTTAT GTTATTGATCCGGAAGGCGCGCCAAGCACGGGAGGTAC TTCTGAAAGCGCTACTCCGGAGTCCGGTCCAGGTACCT CTACCGAACCGTCCGAAGGCAGCGCTCCAGGTACTTCT ACTGAACCTTCTGAGGGTAGCGCTCCAGGTACTTCTGA AAGCGCTACTCCGGAGTCCGGTCCAGGTACCTCTACCG AACCGTCCGAAGGCAGCGCTCCAGGTACTTCTACTGAA CCTTCTGAGGGTAGCGCTCCAGGTACCTCTGAAAGCGC TACTCCGGAGTCTGGCCCAGGTACCTCTACTGAACCGT CTGAGGGTAGCGCTCCAGGTACTTCTACTGAACCGTCC GAAGGTAGCGCACCAGGTACTTCTACCGAACCGTCCGA GGGTAGCGCACCAGGTAGCCCAGCAGGTTCTCCTACCT CCACCGAGGAAGGTACTTCTACCGAACCGTCCGAGGGT AGCGCACCAGGTCCAGAACCAACGGGGCCGGCCATGC ATGTGGCCCAGCCAGCCGTGGTGCTGGCAAGTTCACGC GGTATTGCATCATTTGTGTGCGAATATGCATCACCTGGT AAAGCCACAGAAGTGCGTAACAGTACTGCGTCAGGC CGATTCACAGGTGACAGAAGTTTGCGCTGCCACATACA TGATGGGCAACGAGCTGACATTCCTGGACGATTCAATT TGTACTGGTACAAGCTCAGGCAATCAGGTGAACCTGAC AATCCAAGGCCTGAGAGCTATGGACACAGGCCTGTACA TCTGCAAAGTTGAGCTGATGTACCCTCCGCCTTATTACT TAGGCATTGGCAACGGTACACAGATCTATGTGATCGAT CCTGAGGGAGGTAGCCCGGCTGGCTCTCCTACCTCTAC TGAGGAAGGTACTTCTGAAAGCGCTACTCCTGAGTCTG GTCCAGGTACCTCTACTGAACCGTCCGAAGGTAGCGCT CCAGGTAGCCCAGCAGGCTCTCCGACTTCCACTGAGGA AGGTACTTCTACTGAACCTTCCGAAGGCAGCGCACCAG GTACCTCTACTGAACCTTCTGAGGGCAGCGCTCCAGGT ACTTCTGAAAGCGCTACCCCGGAATCTGGCCCAGGTAG CGAACCGGCTACTTCTGGTTCTGAAACCCCAGGTAGCG AACCGGCTACCTCCGGTTCTGAAACTCCAGGTAGCCCG GCAGGCTCTCCGACCTCTACTGAGGAAGGTACTTCTGA AAGCGCAACCCCGGAGTCCGGCCCAGGTACTTCTACCG AACCGTCTGAGGGCAGCGCACCAGGTACTTCTACCGAA CCGTCCGAGGGTAGCGCACCAGGTAGCCCAGCAGGTTC TCCTACCTCCACCGAGGAAGGTACTTCTACCGAACCGT CCGAGGGTAGCGCACCAGGTACCTCTACTGAACCTTCT GAGGGCAGCGCTCCAGGTACTTCTGAAAGCGCTACCCC GGAGTCCGGTCCAGGTACTTCTACTGAACCGTCCGAAG GTAGCGCACCAGGTACTTCTGAAAGCGCAACCCCTGAA TCCGGTCCAGGTAGCGAACCGGCTACTTCTGGCTCTGA GACTCCAGGTACTTCTACCGAACCGTCCGAAGGTAGCG CACCAGGTACTTCTACTGAACCGTCTGAAGGTAGCGCA CCAGGTACTTCTGAAAGCGCAACCCCGGAATCCGGCCC AGGTACCTCTGAAAGCGCAACCCCGGAGTCCGGCCCAG GTAGCCCTGCTGGCTCTCCAACCTCCACCGAAGAAGGT | 700 | MAMHVAQPAVV LASSRGIASFVCE YASPGKATEVRV TVLRQADSQVTE VCAATYMMGNE LTFLDDSICTGTS SGNQVNLTIQGL RAMDTGLYICKV ELMYPPPYYLGIG NGTQIYVIDPEGA PSTGGTSESATPE SGPGTSTEPSEGS APGTSTEPSEGSA PGTSESATPESGP GTSTEPSEGSAPG TSTEPSEGSAPGT SESATPESGPGTS TEPSEGSAPGTST EPSEGSAPGTSTE PSEGSAPGTSTE PSEGSAPGSPAGS PTSTEEGTSTEPS EGSAPGPEPTGPA MHVAQPAVVLA SSRGIASFVCEYA SPGKATEVRVTV LRQADSQVTEVC AATYMMGNELT FLDDSICTGTSSG NQVNLTIQGLRA MDTGLYICKVEL MYPPPYYLGIGN GTQIYVIDPEGGS PAGSPTSTEEGTS ESATPESGPGTST EPSEGSAPGSPAG SPTSTEEGTSTEPS EGSAPGTSTEPSE GSAPGTSESATPE SGPGSEPATSGSE TPGSEPATSGSET PGSPAGSPTSTEE GTSESATPESGPG TSTEPSEGSAPGT STEPSEGSAPGSP AGSPTSTEEGTST EPSEGSAPGTSTE PSEGSAPGTSESA TPESGPGTSTEPS EGSAPGTSESATP ESGPGSEPATSGS ETPGTSTEPSEGS APGTSTEPSEGSA PGTSESATPESGP GTSESATPESGPG SPAGSPTSTEEGT | 725 |

TABLE 25-continued

DNA and amino acid sequences of binding fusion protein constructs

| Clone Name | DNA Sequence | SEQ ID NO: | Amino Acid Sequence | SEQ ID NO: |
|---|---|---|---|---|
| | ACCTCTGAAAGCGCAACCCCTGAATCCGGCCCAGGTAG | | SESATPESGPGSE | |
| | CGAACCGGCAACCTCCGGTTCTGAAACCCCAGGTACCT | | PATSGSETPGTSE | |
| | CTGAAAGCGCTACTCCGGAGTCTGGCCCAGGTACCTCT | | SATPESGPGTSTE | |
| | ACTGAACCGTCTGAGGGTAGCGCTCCAGGTACTTCTAC | | PSEGSAPGTSTEP | |
| | TGAACCGTCCGAAGGTAGCGCACCAGGTACTTCTACCG | | SEGSAPGTSTEPS | |
| | AACCGTCCGAAGGCAGCGCTCCAGGTACCTCTACTGAA | | EGSAPGTSTEPSE | |
| | CCTTCCGAGGGCAGCGCTCCAGGTACCTCTACCGAACC | | GSAPGTSTEPSEG | |
| | TTCTGAAGGTAGCGCACCAGGTACTTCTACCGAACCGT | | SAPGTSTEPSEGS | |
| | CCGAGGGTAGCGCACCAGGTAGCCCAGCAGGTTCTCCT | | APGSPAGSPTSTE | |
| | ACCTCCACCGAGGAAGGTACTTCTACCGAACCGTCCGA | | EGTSTEPSEGSAP | |
| | GGGTAGCGCACCAGGTACCTCTGAAAGCGCAACTCCTG | | GTSESATPESGPG | |
| | AGTCTGGCCCAGGTAGCGAACCTGCTACCTCCGGCTCT | | SEPATSGSETPGT | |
| | GAGACTCCAGGTACCTCTGAAAGCGCAACCCCGGAATC | | SESATPESGPGSE | |
| | TGGTCCAGGTAGCGAACCTGCAACCTCTGGCTCTGAAA | | PATSGSETPGTSE | |
| | CCCCAGGTACCTCTGAAAGCGCTACTCCTGAATCTGGC | | SATPESGPGTSTE | |
| | CCAGGTACTTCTACTGAACCGTCCGAGGGCAGCGCACC | | PSEGSAPGTSESA | |
| | AGGTACTTCTGAAAGCGCTACTCCTGAGTCCGGCCCAG | | TPESGPGSPAGSP | |
| | GTAGCCCGGCTGGCTCTCCGACTTCCACCGAGGAAGGT | | TSTEEGSPAGSPT | |
| | AGCCCGGCTGGCTCTCCAACTTCTACTGAAGAAGGTAG | | STEEGSPAGSPTS | |
| | CCCGGCAGGCTCTCCGACCTCTACTGAGGAAGGTACTT | | TEEGTSESATPES | |
| | CTGAAAGCGCAACCCCGGAGTCCGGCCCAGGTACCTCT | | GPGTSTEPSEGSA | |
| | ACCGAACCGTCTGAGGGCAGCGCACCAGGTACCTCTGA | | PGTSESATPESGP | |
| | AAGCGCAACTCCTGAGTCTGGCCCAGGTATGCGAACCTG | | GSEPATSGSETPG | |
| | CTACCTCCGGCTCTGAGACTCCAGGTACCTCTGAAAGC | | TSESATPESGPGS | |
| | GCAACCCCGGAATCTGGTCCAGGTAGCGAACCTGCAAC | | EPATSGSETPGTS | |
| | CTCTGGCTCTGAAACCCCAGGTACCTCTGAAAGCGCTA | | ESATPESGPGTST | |
| | CTCCTGAATCTGGCCCAGGTACTTCTACTGAACCGTCCG | | EPSEGSAPGSPAG | |
| | AGGGCAGCGCACCAGGTAGCCCTGCTGGCTCTCCAACC | | SPTSTEEGTSESA | |
| | TCCACCGAAGAAGGTACCTCTGAAAGCGCAACCCCTGA | | TPESGPGSEPATS | |
| | ATCCGGCCCAGGTAGCGAACCGGCAACCTCCGGTTCTG | | GSETPGTSESATP | |
| | AAACCCCAGGTACTTCTGAAAGCGCTACTCCTGAGTCC | | ESGPGSPAGSPTS | |
| | GGCCCAGGTAGCCCGGCTGGCTCTCCGACTTCCACCGA | | TEEGSPAGSPTST | |
| | GGAAGGTAGCCCGGCTGGCTCTCCAACTTCTACTGAAG | | EEGTSTEPSEGSA | |
| | AAGGTACTTCTACCGAACCTTCCGAGGGCAGCGCACCA | | PGTSESATPESGP | |
| | GGTACTTCTGAAAGCGCTACCCCTGAGTCCGGCCCAGG | | GTSESATPESGPG | |
| | TACTTCTGAAAGCGCTACTCCTGAATCCGGTCCAGGTA | | TSESATPESGPGS | |
| | CTTCTGAAAGCGCTACCCCGGAATCTGGCCCAGGTAGC | | EPATSGSETPGSE | |
| | GAACCGGCTACTTCTGGTTCTGAAACCCCAGGTAGCGA | | PATSGSETPGSPA | |
| | ACCGGCTACCTCCGGTTCTGAAACTCCAGGTAGCCCAG | | GSPTSTEEGTSTE | |
| | CAGGCTCTCCGACTTCCACTGAGGAAGGTACTTCTACT | | PSEGSAPGTSTEP | |
| | GAACCTTCCGAAGGCAGCGCACCAGGTACCTCTACTGA | | SEGSAPGSEPATS | |
| | ACCTTCTGAGGGCAGCGCTCCAGGTAGCGAACCTGCAA | | GSETPGTSESATP | |
| | CCTCTGGCTCTGAAACCCCAGGTACCTCTGAAAGCGCT | | ESGPGTSTEPSEG | |
| | ACTCCTGAATCTGGCCCAGGTACTTCTACTGAACCGTCC | | SAPG | |
| | GAGGGCAGCGCACCAGGTTAA | | | |
| CTLA4-AE158-CTLA4-AE864, AC392 | ATGGCAATGCATGTTGCACAGCCTGCAGTTGTTCTGGC AAGCAGCCGTGGTATTGCCAGCTTTGTTTGTGAATATGC AAGTCCGGGTAAAGCAACCGAAGTTCGTGTTACCGTTC TGAGACAGGCAGATAGCCAGGTTACCGAAGTTTGTGCA GCAACCTATATGATGGGTAATGAACTGACCTTTCTGGA TGATAGCATTTGTACCGGCACCAGCAGCGGTAATCAGG TTAATCTGACCATTCAGGGTCTGCGTGCAATGGATACC GGTCTGTATATTTGTAAAGTGGAACTGATGTATCCGCCT CCGTATTATCTGGGTATTGGTAATGGCACCCAGATTTAT GTTATTGATCCGGAACCGTGTCCGGATAGCGGCGCGCC AAGCACGGGAGGTACTTCTGAAAGCGCTACTCCGGAGT CCGGTCCAGGTACCTCTACCGAACCGTCCGAAGGCAGC GCTCCAGGTACTTCTACTGAACCTTCTGAGGGTAGCGCT CCAGGTACTTCTGAAAGCGCTACTCCGGAGTCCGGTCC AGGTACCTCTACCGAACCGTCCGAAGGCAGCGCTCCAG GTACTTCTACTGAACCTTCTGAGGGTAGCGCTCCAGGT ACCTCTGAAAGCGCTACTCCGGAGTCTGGCCCAGGTAC CTCTACTGAACCGTCTGAGGGTAGCGCTCCAGGTACTT CTACTGAACCGTCCGAAGGTAGCGCACCAGGTACTTCT ACCGAACCGTCCGAGGGTAGCGCACCAGGTAGCCCAGC AGGTTCTCCTACCTCCACCGAGGAAGGTACTTCTACCG AACCGTCCGAGGGTAGCGCACCAGGTCCAGAACCCAAC GGGGCCGCCATGCATGTGGCCCAGCCAGCCGTGGTGC TGGCAAGTTCACGCGGTATTGCATCATTTGTGTGCGAAT ATGCATCACCTGGTAAAGCCACAGAAGTGCGCGTAACA GTACTGCGTCAGGCCGATTCACAGGTGACAGAAGTTTG CGCTGCCACATACATGATGGGCAACGAGCTGACATTCC TGGACGATTCAATTTGTACTGGTACAAGCTCAGGCAAT | 701 | MAMHVAQPAVV LASSRGIASFVCE YASPGKATEVRV TVLRQADSQVTE VCAATYMMGNE LTFLDDSICTGTS SGNQVNLTIQGL RAMDTGLYICKV ELMYPPPYYLGIG NGTQIYVIDPEPC PDSGAPSTGGTSE SATPESGPGTSTE PSEGSAPGTSTEP SEGSAPGTSESAT PESGPGTSTEPSE GSAPGTSTEPSEG SAPGTSESATPES GPGTSTEPSEGSA PGTSTEPSEGSAP GTSTEPSEGSAPG SPAGSPTSTEEGT STEPSEGSAPGPE PTGPAMHVAQPA VVLASSRGIASFV CEYASPGKATEV RVTVLRQADSQV TEVCAATYMMG NELTFLDDSICTG | 726 |

TABLE 25-continued

DNA and amino acid sequences of binding fusion protein constructs

| Clone Name | DNA Sequence | SEQ ID NO: Amino Acid Sequence | SEQ ID NO: |
|---|---|---|---|
| | CAGGTGAACCTGACAATCCAAGGCCTGAGAGCTATGGA | TSSGNQVNLTIQG | |
| | CACAGGCCTGTACATCTGCAAAGTTGAGCTGATGTACC | LRAMDTGLYICK | |
| | CTCCGCCTTATTACTTAGGCATTGGCAACGGTACACAG | VELMYPPPYYLGI | |
| | ATCTATGTGATCGATCCTGAACCTTGCCCTGATTCAGGA | GNGTQIYVIDPEP | |
| | GGTAGCCCGGCTGGCTCTCCTACCTCTACTGAGGAAGG | CPDSGGSPAGSPT | |
| | TACTTCTGAAAGCGCTACTCCTGAGTCTGGTCCAGGTAC | STEEGTSESATPE | |
| | CTCTACTGAACGTCCGAAGGTAGCGCTCCAGGTAGCC | SGPGTSTEPSEGS | |
| | CAGCAGGCTCTCCGACTTCCACTGAGGAAGGTACTTCT | APGSPAGSPTSTE | |
| | ACTGAACCTTCCGAAGGCAGCGCACCAGGTACCTCTAC | EGTSTEPSEGSAP | |
| | TGAACCTTCTGAGGGCAGCGCTCCAGGTACTTCTGAAA | GTSTEPSEGSAPG | |
| | GCGCTACCCCGGAATCTGGCCCAGGTAGCGAACCGGCT | TSESATPESGPGS | |
| | ACTTCTGGTTCTGAAACCCCAGGTAGCGAACCGGCTAC | EPATSGSETPGSE | |
| | CTCCGGTTCTGAAACTCCAGGTAGCCCGGCAGGCTCTC | PATSGSETPGSPA | |
| | CGACCTCTACTGAGGAAGGTACTTCTGAAAGCGCAACC | GSPTSTEEGTSES | |
| | CCGGAGTCCGGCCCAGGTACCTCTACCGAACCGTCTGA | ATPESGPGTSTEP | |
| | GGGCAGCGCACCAGGTACTTCTACCGAACCGTCCGAGG | SEGSAPGTSTEPS | |
| | GTAGCGCACCAGGTAGCCCAGCAGGTTCTCCTACCTCC | EGSAPGSPAGSPT | |
| | ACCGAGGAAGGTACTTCTACCGAACCGTCCGAGGGTAG | STEEGTSTEPSEG | |
| | CGCACCAGGTACCTCTACTGAACCTTCTGAGGGCAGCG | SAPGTSTEPSEGS | |
| | CTCCAGGTACTTCTGAAAGCGCTACCCCGGAGTCCGGT | APGTSESATPESG | |
| | CCAGGTACTTCTACTGAACCGTCCGAAGGTAGCGCACC | PGTSTEPSEGSAP | |
| | AGGTACTTCTGAAAGCGCAACCCCTGAATCCGGTCCAG | GTSESATPESGPG | |
| | GTAGCGAACCGGCTACTTCTGGCTCTGAGACTCCAGGT | SEPATSGSETPGT | |
| | ACTTCTACCGAACCGTCCGAAGGTAGCGCACCAGGTAC | STEPSEGSAPGTS | |
| | TTCTACTGAACCGTCTGAAGGTAGCGCACCAGGTACTT | TEPSEGSAPGTSE | |
| | CTGAAAGCGCAACCCCGGAATCCGGCCCAGGTACCTCT | SATPESGPGTSES | |
| | GAAAGCGCAACCCCGGAGTCCGGCCAGGTAGCCCTGC | ATPESGPGSPAGS | |
| | TGGCTCTCCAACCTCCACCGAAGAAGGTACCTCTGAAA | PTSTEEGTSESAT | |
| | GCGCAACCCCTGAATCCGGCCCAGGTAGCGAACCGGCA | PESGPGSEPATSG | |
| | ACCTCCGGTTCTGAAACCCCAGGTACCTCTGAAAGCGC | SETPGTSESATPE | |
| | TACTCCGGAGTCTGGCCCAGGTACCTCTACTGAACCGT | SGPGTSTEPSEGS | |
| | CTGAGGGTAGCGCTCCAGGTACTTCTACTGAACCGTCC | APGTSTEPSEGSA | |
| | GAAGGTAGCGCACCAGGTACTTCTACCGAACCGTCCGA | PGTSTEPSEGSAP | |
| | AGGCAGCGCTCCAGGTACCTCTACTGAACCTTCCGAGG | GTSTEPSEGSAPG | |
| | GCAGCGCTCCAGGTACCTCTACCGAACCTTCTGAAGGT | TSTEPSEGSAPGT | |
| | AGCGCACCAGGTACTTCTACCGAACCGTCCGAGGGTAG | STEPSEGSAPGSP | |
| | CGCACCAGGTAGCCCAGCAGGTTCTCCTACCTCCACCG | AGSPTSTEEGTST | |
| | AGGAAGGTACTTCTACCGAACCGTCCGAGGGTAGCGCA | EPSEGSAPGTSES | |
| | CCAGGTACCTCTGAAAGCGCAACTCCTGAGTCTGGCCC | ATPESGPGSEPAT | |
| | AGGTAGCGAACCTGCTACCTCCGGCTCTGAGACTCCAG | SGSETPGTSESAT | |
| | GTACCTCTGAAAGCGCAACCCCGGAATCTGGTCCAGGT | PESGPGSEPATSG | |
| | AGCGAACCTGCAACCTCTGGCTCTGAAACCCCAGGTAC | SETPGTSESATPE | |
| | CTCTGAAAGCGCTACTCCTGAATCTGGCCCAGGTACTTC | SGPGTSTEPSEGS | |
| | TACTGAACCGTCCGAGGGCAGCGCACCAGGTACTTCTG | APGTSESATPESG | |
| | AAAGCGCTACTCCTGAGTCCGGCCCAGGTAGCCCGGCT | PGSPAGSPTSTEE | |
| | GGCTCTCCGACTTCCACCGAGGAAGGTAGCCCGGCTGG | GSPAGSPTSTEEG | |
| | CTCTCCAACTTCTACTGAAGAAGGTAGCCCGGCAGGCT | SPAGSPTSTEEGT | |
| | CTCCGACCTCTACTGAGGAAGGTACTTCTGAAAGCGCA | SESATPESGPGTS | |
| | ACCCCGGAGTCCGGCCCAGGTACCTCTACCGAACCGTC | TEPSEGSAPGTSE | |
| | TGAGGGCAGCGCACCAGGTACCTCTGAAAGCGCAACTC | SATPESGPGSEPA | |
| | CTGAGTCTGGCCCAGGTAGCGAACCTGCTACCTCCGGC | TSGSETPGTSESA | |
| | TCTGAGACTCCAGGTACCTCTGAAAGCGCAACCCCGGA | TPESGPGSEPATS | |
| | ATCTGGTCCAGGTAGCGAACCTGCAACCTCTGGCTCTG | GSETPGTSESATP | |
| | AAACCCCAGGTACCTCTGAAAGCGCTACTCCTGAATCT | ESGPGTSTEPSEG | |
| | GGCCCAGGTACTTCTACTGAACCGTCCGAGGGCAGCGC | SAPGSPAGSPTST | |
| | ACCAGGTAGCCCTGCTGGCTCTCCAACCTCCACCGAAG | EEGTSESATPESG | |
| | AAGGTACCTCTGAAAGCGCAACCCCTGAATCCGGCCCA | PGSEPATSGSETP | |
| | GGTAGCGAACCGGCAACCTCCGGTTCTGAAACCCCAGG | GTSESATPESGPG | |
| | TACTTCTGAAAGCGCTACTCCTGAGTCCGGCCCAGGTA | SPAGSPTSTEEGS | |
| | GCCCGGCTGGCTCTCCGACTTCCACCGAGGAAGGTAGC | PAGSPTSTEEGTS | |
| | CCGGCTGGCTCTCCAACTTCTACTGAAGAAGGTACTTCT | TEPSEGSAPGTSE | |
| | ACCGAACCTTCCGAGGGCAGCGCACCAGGTACTTCTGA | SATPESGPGTSES | |
| | AAGCGCTACCCCTGAGTCCGGCCCAGGTACTTCTGAAA | ATPESGPGTSESA | |
| | GCGCTACTCCTGAATCCGGTCCAGGTACTTCTGAAAGC | TPESGPGSEPATS | |
| | GCTACCCCGGAATCTGGCCCAGGTAGCGAACCGGCTAC | GSETPGSEPATSG | |
| | TTCTGGTTCTGAAACCCAGGTAGCGAACCGGCTACCT | SETPGSPAGSPTS | |
| | CCGGTTCTGAAACTCCAGGTAGCCCAGCAGGCTCTCCG | TEEGTSTEPSEGS | |
| | ACTTCCACTGAGGAAGGTACTTCTACTGAACCTTCCGA | APGTSTEPSEGSA | |
| | AGGCAGCGCACCAGGTACCTCTACTGAACCTTCTGAGG | PGSEPATSGSETP | |
| | GCAGCGCTCCAGGTAGCGAACCTGCAACCTCTGGCTCT | GTSESATPESGPG | |
| | GAAACCCCAGGTACCTCTGAAAGCGCTACTCCTGAATC | TSTEPSEGSAPG | |
| | TGGCCCAGGTACTTCTACTGAACCGTCCGAGGGCAGCG | | |
| | CACCAGGTTAA | | |

TABLE 25-continued

DNA and amino acid sequences of binding fusion protein constructs

| Clone Name | DNA Sequence | SEQ ID NO: | Amino Acid Sequence | SEQ ID NO: |
|---|---|---|---|---|
| AE912-aIL6R scFv, AC341 | ATGGCTGAACCTGCTGGCTCTCCAACCTCCACTGAGGA<br>AGGTACCCCGGGTAGCGGTACTGCTTCTTCCTCTCCAGG<br>TAGCTCTACCCCTTCTGGTGCAACCGGCTCTCCAGGTGC<br>TTCTCCGGGCACCAGCTCTACCGGTTCTCCAGGTAGCCC<br>GGCTGGCTCTCCTACCTCTACTGAGGAAGGTACTTCTGA<br>AAGCGCTACTCCTGAGTCTGGTCCAGGTACCTCTACTG<br>AACCGTCCGAAGGTAGCGCTCCAGGTAGCCCAGCAGGC<br>TCTCCGACTTCCACTGAGGAAGGTACTTCTACTGAACCT<br>TCCGAAGGCAGCGCACCAGGTACCTCTACTGAACCTTC<br>TGAGGGCAGCGCTCCAGGTACTTCTGAAAGCGCTACCC<br>CGGAATCTGGCCCAGGTATGCGAACCGGCTACTTCTGGT<br>TCTGAAACCCCAGGTAGCGAACCGGCTACCTCCGGTTC<br>TGAAACTCCAGGTAGCCCGGCAGGCTCTCCGACCTCTA<br>CTGAGGAAGGTACTTCTGAAAGCGCAACCCCGGAGTCC<br>GGCCCAGGTACCTCTGAACCGTCTGAGGGCAGCGC<br>ACCAGGTACTTCTACCGAACCGTCCGAGGGTAGCGCAC<br>CAGGTAGCCCAGCAGGTTCTCCTACCTCCACCGAGGAA<br>GGTACTTCTACCGAACCGTCCGAGGGTAGCGCACCAGG<br>TACCTCTACTGAACCTTCTGAGGGCAGCGCTCCAGGTA<br>CTTCTGAAAGCGCTACCCCGGAGTCCGGTCCAGGTACT<br>TCTACTGAACCGTCCGAAGGTAGCGCACCAGGTACTTC<br>TGAAAGCGCAACCCCTGAATCCGGTCCAGGTAGCGAAC<br>CGGCTACTTCTGGCTCTGAACCTCCAGGTACTTCTACCG<br>AACCGTCCGAAGGTAGCGCACCAGGTACTTCTACTGAA<br>CCGTCTGAAGGTAGCGCACCAGGTACTTCTGAAAGCGC<br>AACCCCGGAATCCGGCCCAGGTACCTCTGAAAGCGCAA<br>CCCCGGAGTCCGGCCCAGGTAGCCCTGCTGGCTCTCCA<br>ACCTCCACCGAAGAAGGTACCTCTGAAAGCGCAACCCC<br>TGAATCCGGCCCAGGTAGCGAACCGGCAACCTCCGGTT<br>CTGAAACCCCAGGTACCTCTGAAAGCGCTACTCCGGAG<br>TCTGGCCCAGGTACCTCTACTGAACCGTCCGAGGGTAG<br>CGCTCCAGGTACTTCTACTGAACCGTCCGAAGGTAGCG<br>CACCAGGTACTTCTACCGAACCGTCCGAAGGCAGCGCT<br>CCAGGTACCTCTACTGAACCTTCCGAGGGCAGCGCTCC<br>AGGTACCTCTACCGAACCTTCTGAAGGTAGCGCACCAG<br>GTACTTCTACCGAACCGTCGAGGGTAGCGCACCAGGT<br>AGCCCAGCAGGTTCTCCTACCTCCACCGAGGAAGGTAC<br>TTCTACCGAACCGTCCGAGGGTAGCGCACCAGGTACCT<br>CTGAAAGCGCAACTCCTGAGTCTGGCCCAGGTAGCGAA<br>CCTGCTACCTCCGGCTCTGAGACTCCAGGTACCTCTGAA<br>AGCGCAACCCCGGAATCTGGTCAGGTAGCGAACCTGC<br>AACCTCTGGCTCTGAAACCCCAGGTACCTCTGAAAGCG<br>CTACTCCTGAATCTGGCCCAGGTACTTCTACTGAACCGT<br>CCGAGGGCAGCGCACCAGGTACTTCTGAAAGCGCTACT<br>CCTGAGTCCGGCCCAGGTAGCCCGGCTGGCTCTCCGAC<br>TTCCACCGAGGAAGGTAGCCCGGCTGGCTCTCCAACTT<br>CTACTGAAGAAGGTAGCCCGGCAGGCTCTCCGACCTCT<br>ACTGAGGAAGGTACTTCTGAAAGCGCAACCCCGGAGTC<br>CGGCCCAGGTACCTCTACCGAACCGTCTGAGGGCAGCG<br>CACCAGGTACCTCTGAAAGCGCAACTCCTGAGTCTGGC<br>CCAGGTAGCGAACCTGCTACCTCCGGCTCTGAGACTCC<br>AGGTACCTCTGAAAGCGCAACCCCGGAATCTGGTCCAG<br>GTAGCGAACCTGCAACCTCTGGCTCTGAAACCCCAGGT<br>ACCTCTGAAAGCGCTACTCCTGAATCTGGCCCAGGTAC<br>TTCTACTGAACCGTCCGAGGGCAGCGCACCAGGTAGCC<br>CTGCTGGCTCTCCAACCTCCACCGAAGAAGGTACCTCT<br>GAAAGCGCAACCCCTGAATCCGGCCAGGTAGCGAACC<br>GGCAACCTCCGGTTCTGAAACCCCAGGTACTTCTGAAA<br>GCGCTACTCCTGAGTCCGGCCCAGGTAGCCCGGCTGGC<br>TCTCCGACTTCCACCGAGGAAGGTAGCCCGGCTGGCTC<br>TCCAACTTCTACTGAAGAAGGTACTTCTACCGAACCTTC<br>CGAGGGCAGCGCACCAGGTACTTCTGAAAGCGCTACCC<br>CTGAGTCCGGCCAGGTACTTCTGAAAGCGCTACTCCT<br>GAATCCGGTCAGGTACTTCTGAAAGCGCTACCCCGGA<br>ATCTGGCCCAGGTAGCGAACCGGCTACTTCTGGTTCTG<br>AAACCCCAGGTAGCGAACCGGCTACCTCCGGTTCTGAA<br>ACTCCAGGTAGCCCAGCAGGCTCTCCGACTTCCACTGA<br>GGAAGGTACTTCTACTGAACCTTCCGAAGGCAGCGCAC<br>CAGGTCTACTGAACCGTCTGAGGGCAGCGCTCCA<br>GGTAGCGAACCTGCAACCTCTGGCTCTGAAACCCCAGG<br>TACCTCTGAAAGCGCTACTCCTGAATCTGGCCCAGGTA<br>CTTCTACTGAACCGTCCGAGGGCAGCGCACCAGGTGCT<br>GATATTCAAATGACTCAATCTCCTTCTTCTCTGTCCGCA<br>TCTGTAGGCGACCGTGTAACCATCACTTGCCGTGCCTCC | 702 | MAEPAGSPTSTEE<br>GTPGSGTASSSPG<br>SSTPSGATGSPGA<br>SPGTSSTGSPGSP<br>AGSPTSTEEGTSE<br>SATPESGPGTSTE<br>PSEGSAPGSPAGS<br>PTSTEEGTSTEPS<br>EGSAPGTSTEPSE<br>GSAPGTSESATPE<br>SGPGSEPATSGSE<br>TPGSEPATSGSET<br>PGSPAGSPTSTEE<br>GTSESATPESGPG<br>TSTEPSEGSAPGT<br>STEPSEGSAPGSP<br>AGSPTSTEEGTST<br>EPSEGSAPGTSTE<br>PSEGSAPGTSESA<br>TPESGPGTSTEPS<br>EGSAPGTSESATP<br>ESGPGSEPATSGS<br>ETPGTSTEPSEGS<br>APGTSTEPSEGSA<br>PGTSESATPESGP<br>GTSESATPESGPG<br>SPAGSPTSTEEGT<br>SESATPESGPGSE<br>PATSGSETPGTSE<br>SATPESGPGTSTE<br>PSEGSAPGTSTEP<br>SEGSAPGTSTEPS<br>EGSAPGTSTEPSE<br>GSAPGTSTEPSEG<br>SAPGTSTEPSEGS<br>APGSPAGSPTSTE<br>EGTSTEPSEGSAP<br>GTSESATPESGPG<br>SEPATSGSETPGT<br>SESATPESGPGSE<br>PATSGSETPGTSE<br>SATPESGPGTSTE<br>PSEGSAPGTSESA<br>TPESGPGSPAGSP<br>TSTEEGSPAGSPT<br>STEEGSPAGSPTS<br>TEEGTSESATPES<br>GPGTSTEPSEGSA<br>PGTSESATPESGP<br>GSEPATSGSETPG<br>TSESATPESGPGS<br>EPATSGSETPGTS<br>ESATPESGPGTST<br>EPSEGSAPGSPAG<br>SPTSTEEGTSESA<br>TPESGPGSEPATS<br>GSETPGTSESATP<br>ESGPGSPAGSPTS<br>TEEGSPAGSPTST<br>EEGTSTEPSEGSA<br>PGTSESATPESGP<br>GTSESATPESGPG<br>TSESATPESGPGS<br>EPATSGSETPGSE<br>PATSGSETPGSPA<br>GSPTSTEEGTSTE<br>PSEGSAPGTSTEP<br>SEGSAPGSEPATS<br>GSETPGTSESATP<br>ESGPGTSTEPSEG<br>SAPGADIQMTQS<br>PSSLSASVGDRVT<br>ITCRASQDISSYL<br>NWYQQKPGKAP | 727 |

TABLE 25-continued

DNA and amino acid sequences of binding fusion protein constructs

| Clone Name | DNA Sequence | SEQ ID NO: | Amino Acid Sequence | SEQ ID NO: |
|---|---|---|---|---|
| | CAGGACATCTCCAGCTACCTGAACTGGTACCAGCAGAA | | KLLIYYTSRLHSG | |
| | GCCGGGCAAGGCTCCGAAACTGCTGATTTATTACACTA | | VPSRFSGSGSGTD | |
| | GCCGTCTGCATTCTGGTGTTCCGAGCCGCTTCTCCGGTT | | FTFTISSLQPEDIA | |
| | CTGGCAGCGGTACCGATTTCACTTTTACTATCTCCAGCC | | TYYCQQGNTLPY | |
| | TGCAACCGGAGGACATCGCGACGTACTATTGCCAGCAA | | TFGQGTKVEIKT | |
| | GGTAATACCCTGCCGTACACCTTCGGCCAAGGCACGAA | | GSGEGSEGEGGG | |
| | AGTTGAAATCAAAACCGGTTCTGGCGAAGGCTCTGAAG | | EGSEGEGSGEGG | |
| | GTGAAGGTGGTGGTGAAGGCTCTGAAGGTGAAGGATCT | | EGEGSGSGVQLQ | |
| | GGTGAAGGTGGCGAAGGTGAGGGTTCTGGATCCCAAGT | | ESGPGLVRPSQTL | |
| | TCAGCTGCAGGAATCTGGTCCGGGTCTGGTTCGTCCGTC | | SLTCTVSGYSITS | |
| | TCAGACCCTGTCCCTGACCTGCACGGTGTCCGGCTACTC | | DHAWSWVRQPP | |
| | TATTACCTCTGACCATGCGTGGTCCTGGGTCCGTCAGCC | | GRGLEWIGYISYS | |
| | ACCGGGTCGCGGTCTGGAGTGGATCGGCTACATCAGCT | | GITTYNPSLKSRV | |
| | ACAGCGGCATCACCACTTACAACCCGTCCCTGAAAAGC | | TMLRDTSKNQFS | |
| | CGTGTCACCATGCTGCGTGACACCTCCAAAAATCAATT | | LRLSSVTAADTA | |
| | CTCCCTGCGCCTGAGCTCTGTGACGGCGGCCGACACTG | | VYYCARSLARTT | |
| | CGGTGTACTACTGCGCTCGCAGCCTGGCGCGTACCACT | | AMDYWGQGSLV | |
| | GCTATGGATTACTGGGGTCAGGGCAGCCTGGTAACCGT | | TVSS | |
| | CAGCAGCTAA | | | |
| aIL6R scFv- AE864, AC342 | ATGGCTGATATTCAAATGACTCAATCTCCTTCTTCTCTG TCCGCATCTGTAGGCGACCGTGTAACCATCACTTGCCGT GCCTCCCAGGACATCTCCAGCTACCTGAACTGGTACCA GCAGAAGCCGGGCAAGGCTCCGAAACTGCTGATTTATT ACACTAGCCGTCTGCATTCTGGTGTTCCGAGCCGCTTCT CCGGTTCTGGCAGCGGTACCGATTTCACTTTTACTATCT CCAGCCTGCAACCGGAGGACATCGCGACGTACTATTGC CAGCAAGGTAATACCCTGCCGTACACCTTCGGCCAAGG CACGAAAGTTGAAATCAAAACCGGTTCTGGCGAAGGCT CTGAAGGTGAAGGTGGTGGTGAAGGCTCTGAAGGTGA AGGATCTGGTGAAGGTGGCGAAGGTGAGGGTTCTGGAT CCCAAGTTCAGCTGCAGGAATCTGGTCCGGGTCTGGTT CGTCCGTCTCAGACCCTGTCCCTGACCTGCACGGTGTCC GGCTACTCTATTACCTCTGACCATGCGTGGTCCTGGGTC CGTCAGCCACCGGGTCGCGGTCTGGAGTGGATCGGCTA CATCAGCTACAGCGGCATCACCACTTACAACCCGTCGCC TGAAAAGCCGTGTCACCATGCTGCGTGACACCTCCAAA AATCAATTCTCCCTGCGCCTGAGCTCTGTGACGGCGGC CGACACTGCGGTGTACTACTGCGCTCGCAGCCTGGCGC GTACCACTGCTATGGATTACTGGGGTCAGGGCAGCCTG GTAACCGTCAGCAGCGGGTCTCCAGGTAGCCCGGCTGG CTCTCCTACCTCTACTGAGGAAGGTACTTCTGAAAGCGC CTACTCCTGAGTCTGGTCCAGGTACCTCTACTGAACCGT CCGAAGGTAGCGCTCCAGGTACCCAGCAGGCTCTCCG ACTTCCACTGAGGAAGGTACTTCTACTGAACCTTCCGA AGGCAGCGCACCAGGTACCTCTACTGAACCTTCTGAGG GCAGCGCTCCAGGTACTTCTGAAAGCGCTACCCCGGAA TCTGGCCCAGGTAGCGAACCGGCTACTTCTGGTTCTGA AACCCCAGGTAGCGAACCGGCTACCTCCGGTTCTGAAA CTCCAGGTAGCCCGGCAGGCTCTCCGACCTCTACTGAG GAAGGTACTTCTGAAAGCGCAACCCCGGAGTCCGGCCC AGGTACCTCTACCGAACCGTCTGAGGGCAGCGCACCAG GTACTTCTACCGAACCGTCCGAGGGTAGCGCACCAGGT AGCCCAGCAGGTTCTCCTACCTCCACCGAGGAAGGTAC TTCTACCGAACCGTCCGAGGGTAGCGCACCAGGTACCT CTACTGAACCTTCTGAGGGCAGCGCTCCAGGTACTTCT GAAAGCGCTACCCCGGAGTCCGGTCCAGGTACTTCTAC TGAACCGTCCGAAGGTAGCGCACCAGGTACTTCTGAAA GCGCAACCCCTGAATCCGGTCCAGGTAGCGAACCGGCT ACTTCTGGCTCTGAGACTCCAGGTACTTCTACCGAACCG TCCGAAGGTAGCGCACCAGGTACTTCTACCGAACCGTC TGAAGGTAGCGCACCAGGTACTTCTGAAAGCGCAACCC CGGAATCCGGCCCAGGTACCTCTGAAAGCGCAACCCCG GAGTCCGGCCCAGGTAGCCCTGCTGGCTCTCCAACCTC CACCGAAGAAGGTACTTCTGAAAGCGCAACCCCTGAAA CCGGCCCAGGTAGCGAACCGGCAACCTCCGGTTCTGAA ACCCCAGGTACCTCTGAAAGCGCTACTCCGGAGTCTGG CCCAGGTACCTCTACTGAACCGTCTGAGGGTAGCGCTC CAGGTACTTCTACTGAACCGTCCGAAGGTAGCGCACCA GGTACTTCTACCGAACCGTCCGAAGGCAGCGCTCCAGG TACCTCTACCGAACCTTCCGAGGGCAGCGCTCCAGGTA CCTCTACCGAACCTTCTGAAGGTAGCGCACCAGGTACT TCTACCGAACCGTCCGAGGGTAGCGCACCAGGTAGCCC AGCAGGTTCTCCTACCTCCACCGAGGAAGGTACTTCTA | 703 | MADIQMTQSPSS LSASVGDRVTITC RASQDISSYLNW YQQKPGKAPKLL IYYTSRLHSGVPS RFSGSGSGTDFTF TISSLQPEDIATY YCQQGNTLPYTF GQGTKVEIKTGS GEGSEGEGGGEG SEGEGSGEGGEG EGSGSQVQLQES GPGLVRPSQTLSL TCTVSGYSITSDH AWSWVRQPPGR GLEWIGYISYSGI TTYNPSLKSRVT MLRDTSKNQFSL RLSSVTAADTAV YYCARSLARTTA MDYWGQGSLVT VSSGSPGSPAGSP TSTEEGTSESATP ESGPGTSTEPSEG SAPGSPAGSPTST EEGTSTEPSEGSA PGTSESATPESGP GSEPATSGSETPGS EPATSGSETPGSP AGSPTSTEEGTSE SATPESGPGTSTE PSEGSAPGTSTEP SEGSAPGSPAGSP TSTEEGTSTEPSE GSAPGTSTEPSEG SAPGTSESATPES GPGTSESATPESGP GSEPATSGSETPG TSTEPSEGSAPGT STEPSEGSAPGTS ESATPESGPGTSE SATPESGPGTSE SATPESGPGSPAG SPTSTEEGTSESA TPESGPGSEPATS GSETPGTSESATP ESGPGTSTEPSEG SAPGTSTEPSEGS APGTSTEPSEGSA PGTSTEPSEGSAP GTSTEPSEGSAPG TSTEPSEGSAPGS PAGSPTSTEEGTS | 728 |

TABLE 25-continued

DNA and amino acid sequences of binding fusion protein constructs

| Clone Name | DNA Sequence | SEQ ID NO: | Amino Acid Sequence | SEQ ID NO: |
|---|---|---|---|---|
| | CCGAACCGTCCGAGGGTAGCGCACCAGGTACCTCTGAA | | TEPSEGSAPGTSE | |
| | AGCGCAACTCCTGAGTCTGGCCCAGGTAGCGAACCTGC | | SATPESGPGSEPA | |
| | TACCTCCGGCTCTGAGACTCCAGGTACCTCTGAAAGCG | | TSGSETPGTSESA | |
| | CAACCCCGGAATCTGGTCCAGGTAGCGAACCTGCAACC | | TPESGPGSEPATS | |
| | TCTGGCTCTGAAACCCCAGGTACCTCTGAAAGCGCTAC | | GSETPGTSESATP | |
| | TCCTGAATCTGGCCCAGGTACTTCTACTGAACCGTCCGA | | ESGPGTSTEPSEG | |
| | GGGCAGCGCACCAGGTACTTCTGAAAGCGCTACTCCTG | | SAPGTSESATPES | |
| | AGTCCGGCCCAGGTAGCCCGGCTGGCTCTCCGACTTCC | | GPGSPAGSPTSTE | |
| | ACCGAGGAAGGTAGCCCGGCTGGCTCTCCAACTTCTAC | | EGSPAGSPTSTEE | |
| | TGAAGAAGGTAGCCCGGCAGGCTCTCCGACCTCTACTG | | GSPAGSPTSTEEG | |
| | AGGAAGGTACTTCTGAAAGCGCAACCCCGGAGTCCGGC | | TSESATPESGPGT | |
| | CCAGGTACCTCTACCGAACCGTCTGAGGGCAGCGCACC | | STEPSEGSAPGTS | |
| | AGGTACCTCTGAAAGCGCAACTCCTGAGTCTGGCCCAG | | ESATPESGPGSEP | |
| | GTAGCGAACCTGCTACCTCCGGCTCTGAGACTCCAGGT | | ATSGSETPGTSES | |
| | ACCTCTGAAAGCGCAACCCCGGAATCTGGTCCAGGTAG | | ATPESGPGSEPAT | |
| | CGAACCTGCAACCTCTGGCTCTGAAACCCCAGGTACCT | | SGSETPGTSESAT | |
| | CTGAAAGCGCTACTCCTGAATCTGGCCCAGGTACTTCT | | PESGPGTSTEPSE | |
| | ACTGAACCGTCCGAGGGCAGCGCACCAGGTAGCCCTGC | | GSAPGSPAGSPTS | |
| | TGGCTCTCCAACCTCCACCGAAGAAGGTACCTCTGAAA | | TEEGTSESATPES | |
| | GCGCAACCCCTGAATCCGGCCCAGGTAGCGAACCGGCA | | GPGSEPATSGSET | |
| | ACCTCCGGTTCTGAAACCCCAGGTACTTCTGAAAGCGC | | PGTSESATPESGP | |
| | TACTCCTGAGTCCGGCCCAGGTAGCCCGGCTGGCTCTC | | GSPAGSPTSTEEG | |
| | CGACTTCCACCGAGGAAGGTAGCCCGGCTGGCTCTCCA | | SPAGSPTSTEEGT | |
| | ACTTCTACTGAAGAAGGTACTTCTACCGAACCTTCCGA | | STEPSEGSAPGTS | |
| | GGGCAGCGCACCAGGTACTTCTGAAAGCGCTACCCCTG | | ESATPESGPGTSE | |
| | AGTCCGGCCCAGGTACTTCTGAAAGCGCTACTCCTGAA | | SATPESGPGTSES | |
| | TCCGGTCCAGGTACTTCTGAAAGCGCTACCCCGGAATC | | ATPESGPGSEPAT | |
| | TGGCCCAGGTAGCGAACCGGCTACTTCTGGTTCTGAAA | | SGSETPGSEPATS | |
| | CCCCAGGTAGCGAACCGGCTACCTCCGGTTCTGAAACT | | GSETPGSPAGSPT | |
| | CCAGGTAGCCCAGCAGGCTCTCCGACTTCCACTGAGGA | | STEEGTSTEPSEG | |
| | AGGTACTTCTACTGAACCTTCCGAAGGCAGCGCACCAG | | SAPGTSTEPSEGS | |
| | GTACCTCTACTGAACCTTCTGAGGGCAGCGCTCCAGGT | | APGSEPATSGSET | |
| | AGCGAACCTGCAACCTCTGGCTCTGAAACCCCAGGTAC | | PGTSESATPESGP | |
| | CTCTGAAAGCGCTACTCCTGAATCTGGCCCAGGTACTTC | | GTSTEPSEGSAPG | |
| | TACTGAACCGTCCGAGGGCAGCGCACCAGGTTAA | | | |
| AE912- aIL6R- AE144, AC361 | ATGGCTGAACCTGCTGGCTCTCCAACCTCCACTGAGGA AGGTACCCCGGGTAGCGGTACTGCTTCTTCCTCTCCAGG TAGCTCTACCCCTTCTGGTGCAACCGGCTCTCCAGGTGC TTCTCCGGGCACCAGCTCTACCGGTTCTCCAGGTAGCCC GGCTGGCTCTCCTACCTCTACTGAGGAAGGTACTTCTGA AAGCGCTACTCCTGAGTCTGGTCCAGGTACCTCTACTG AACCGTCCGAAGGTAGCGCTCCAGGTAGCCCAGCAGGC TCTCCGACTTCCACTGAGGAAGGTACTTCTACTGAACCT TCCGAAGGCAGCGCACCAGGTACCTCTACTGAACCTTC TGAGGGCAGCGCTCCAGGTACTTCTGAAAGCGCTACCC CGGAATCTGGCCCAGGTAGCGAACCGGCTACTTCTGGT TCTGAAACCCCAGGTAGCGAACCGGCTACCTCCGGTTC TGAAACTCCAGGTAGCCCGGCAGGCTCTCCGACCTCTA CTGAGGAAGGTACTTCTGAAAGCGCAACCCCGGAGTCC GGCCCAGGTACCTCTACCGAACCGTCTGAGGGCAGCGC ACCAGGTACTTCTACCGAACCGTCCGAGGGCAGCGCGAGCCCAGCAGGTTCTCCTACCTCCACCGAGGAA GGTACTTCTACCGAACCGTCCGAGGGTAGCGCACCAGG TACCTCTACTGAACCTTCTGAGGGCAGCGCTCCAGGTA CTTCTGAAAGCGCTACCCCGGAGTCCGGTCCAGGTACT TCTACTGAACCGTCCGAAGGTAGCGCACCAGGTACTTC TGAAAGCGCAACCCCTGAATCCGGTCCAGGTAGCGAAC CGGCTACTTCTGGCTCTGAGACTCCAGGTACTTCTACCG AACCGTCCGAAGGTAGCGCACCAGGTACTTCTACTGAA CCGTCTGAAGGTAGCGCACCAGGTACTTCTGAAAGCGP AACCCCGGAATCCGGCCCAGGTACCTCTGAAAGCGCAA CCCCGGAGTCCGGCCCAGGTAGCCCTGCTGGCTCTCCA ACCTCCACCGAAGAAGGTACCTCTGAAAGCGCAACCCC TGAATCCGGCCCAGGTAGCGAACCGGCAACCTCCGGTT CTGAAACCCCAGGTACCTCTGAAAGCGCTACTCCGGAG TCTGGCCCAGGTACCTCTACTGAACCGTCTGAGGGTAG CGCTCCAGGTACTTCTACTGAACCGTCCGAAGGTAGCG CACCAGGTACTTCTACCGAACCGTCCGAAGGCAGCGCT CCAGGTACCTCTACTGAACCTTCCGAGGGCAGCGCTCC AGGTACCTCTACCGAACCTTCTGAAGGTAGCGCACCAG GTACTTCTACCGAACCGTCCGAGGGTAGCGCACCAGGT AGCCCAGCAGGTTCTCCTACCTCCACCGAGGAAGGTAC TTCTACCGAACCGTCCGAGGGTAGCGCACCAGGTACCT | 704 | MAEPAGSPTSTEE GTPGSGTASSSPG SSTPSGATGSPGA SPGTSSTGSPGSP AGSPTSTEEGTSE SATPESGPGTSTE PSEGSAPGSPAGS PTSTEEGTSTEPS EGSAPGTSTEPSE GSAPGTSESATPE SGPGSEPATSGSE TPGSEPATSGSET PGSPAGSPTSTEE GTSESATPESGPG TSTEPSEGSAPGT STEPSEGSAPGSP AGSPTSTEEGTST EPSEGSAPGTSTE PSEGSAPGTSESA TPESGPGTSTEPS EGSAPGTSESATP ESGPGSEPATSGS ETPGTSTEPSEGS APGTSTEPSEGSA PGTSESATPESGP GTSESATPESGPG SPAGSPTSTEEGT SESATPESGPGSE PATSGSETPGTSE SATPESGPGTSTE PSEGSAPGTSTEP SEGSAPGTSTEPS EGSAPGTSTEPSE GSAPGSPAGSPTS TEEGTSTEPSEGSAP EGTSTEPSEGSAP GTSESATPESGPG | 729 |

TABLE 25-continued

DNA and amino acid sequences of binding fusion protein constructs

| Clone Name | DNA Sequence | SEQ ID NO: | Amino Acid Sequence | SEQ ID NO: |
|---|---|---|---|---|
| | CTGAAAGCGCAACTCCTGAGTCTGGCCCAGGTAGCGAA | | SEPATSGSETPGT | |
| | CCTGCTACCTCCGGCTCTGAGACTCCAGGTACCTCTGAA | | SESATPESGPGSE | |
| | AGCGCAACCCCGGAATCTGGTCCAGGTAGCGAACCTGC | | PATSGSETPGTSE | |
| | AACCTCTGGCTCTGAAACCCCAGGTACCTCTGAAAGCG | | SATPESGPGTSTE | |
| | CTACTCCTGAATCTGGCCCAGGTACTTCTACTGAACCGT | | PSEGSAPGTSESA | |
| | CCGAGGGCAGCGCACCAGGTACTTCTGAAAGCGCTACT | | TPESGPGSPAGSP | |
| | CCTGAGTCCGGCCCAGGTAGCCCGGCTGGCTCTCCGAC | | TSTEEGSPAGSPT | |
| | TTCCACCGAGGAAGGTAGCCCGGCTGGCTCTCCAACTT | | STEEGSPAGSPTS | |
| | CTACTGAAGAAGGTAGCCCGGCAGGCTCTCCGACCTCT | | TEEGTSESATPES | |
| | ACTGAGGAAGGTACTTCTGAAAGCGCAACCCCGGAGTC | | GPGTSTEPSEGSA | |
| | CGGCCCAGGTACCTCTACCGAACCGTCTGAGGGCAGCG | | PGTSESATPESGP | |
| | CACCAGGTACCTCTGAAAGCGCAACTCCTGAGTCTGGC | | GSEPATSGSETPG | |
| | CCAGGTAGCGAACCTGCTACCTCCGGCTCTGAGACTCC | | TSESATPESGPGS | |
| | AGGTACCTCTGAAAGCGCAACCCCGGAATCTGGTCCAG | | EPATSGSETPGTS | |
| | GTAGCGAACCTGCAACCTCTGGCTCTGAAACCCCAGGT | | ESATPESGPGTST | |
| | ACCTCTGAAAGCGCTACTCCTGAATCTGGCCCAGGTAC | | EPSEGSAPGSPAG | |
| | TTCTACTGAACCGTCCGAGGGCAGCGCACCAGGTAGCC | | SPTSTEEGTSESA | |
| | CTGCTGGCTCTCCAACCTCCACCGAAGAAGGTACCTCT | | TPESGPGSEPATS | |
| | GAAAGCGCAACCCCTGAATCCGGCCCAGGTAGCGAACC | | GSETPGTSESATP | |
| | GGCAACCTCCGGTTCTGAAACCCCAGGTACTTCTGAAA | | ESGPGSPAGSPTS | |
| | GCGCTACTCCTGAGTCCGGCCCAGGTAGCCCGGCTGGC | | TEEGSPAGSPTST | |
| | TCTCCGACTTCCACCGAGGAAGGTAGCCCGGCTGGCTC | | EEGTSTEPSEGSA | |
| | TCCAACTTCTACTGAAGAAGGTACTTCTACCGAACCTTC | | PGTSESATPESGP | |
| | CGAGGGCAGCGCACCAGGTACTTCTGAAAGCGCTACCC | | GTSESATPESGPG | |
| | CTGAGTCCGGCCCAGGTACTTCTGAAAGCGCTACTCCT | | TSESATPESGPGS | |
| | GAATCCGGTCCAGGTACTTCTGAAAGCGCTACCCCGGA | | EPATSGSETPGSE | |
| | ATCTGGCCCAGGTAGCGAACCGGCTACTTCTGGTTCTG | | PATSGSETPGSE | |
| | AAACCCCAGGTAGCGAACCGGCTACCTCCGGTTCTGAA | | GSPTSTEEGTSTE | |
| | ACTCCAGGTAGCCCAGCAGGCTCTCCGACTTCCACTGA | | PSEGSAPGTSTEP | |
| | GGAAGGTACTTCTACTGAACCTTCCGAAGGCAGCGCAC | | SEGSAPGSEPATS | |
| | CAGGTACCTCTACTGAACCTTCTGAGGGCAGCGCTCCA | | GSETPGTSESATP | |
| | GGTAGCGAACCTGCAACCTCTGGCTCTGAAACCCCAGG | | ESGPGTSTEPSEG | |
| | TACCTCTGAAAGCGCTACTCCTGAATCTGGCCCAGGTA | | SAPGADIQMTQS | |
| | CTTCTACTGAACCGTCCGAGGGCAGCGCACCAGGTGCT | | PSSLSASVGDRVT | |
| | GATATTCAAATGACTCAATCTCCTTCTTCTCTGTCCGCA | | ITCRASQDISSYL | |
| | TCTGTAGGCGACCGTGTAACCATCACTTGCCGTGCCTCC | | NWYQQKPGKAP | |
| | CAGGACATCTCCAGCTACCTGAACTGGTACCAGCAGAA | | KLLIYYTSRLHSG | |
| | GCCGGGCAAGGCTCCGAAACTGCTGATTTATTACACTA | | VPSRFSGSGSGTD | |
| | GCCGTCTGCATTCTGGTGTTCCGAGCCGCTTCTCCGGTT | | FTFTISSLQPEDIA | |
| | CTGGCAGCGGTACCGATTTCACTTTTACTATCTCCAGCC | | TYYCQQGNTLPY | |
| | TGCAACCGGAGGACATCGCGACGTACTATTGCCAGCAA | | TFGQGTKVEIKT | |
| | GGTAATACCCTGCCGTACACCTTCGGCCAAGGCACGAA | | GSGEGSEGEGGG | |
| | AGTTGAAATCAAAACCGGTTCTGGCGAAGGCTCTGAAG | | EGSEGEGSGEGG | |
| | GTGAAGGTGGTGGTGAAGGCTCTGAAGGTGAAGGATCT | | EGEGSGSQVQLQ | |
| | GGTGAAGGTGGCGAAGGTGAGGGTTCTGGATCCCAAGT | | ESGPGLVRPSQTL | |
| | TCAGCTGCAGGAATCTGGTCCGGGTCTGGTTCGTCCGTC | | SLTCTVSGYSITS | |
| | TCAGACCCTGTCCCTGACCTGCACGGTGTCCGGCTACTC | | DHAWSWVRQPP | |
| | TATTACCTCTGACCATGCGTGGTCCTGGGTCCGTCAGCC | | GRGLEWIGYISYS | |
| | ACCGGGTCGCGGTCTGGAGTGGATCGGCTACATCAGCT | | GITTYNPSLKSRV | |
| | ACAGCGGCATCACCACTTACAACCCGTCCCTGAAAAGC | | TMLRDTSKNQFS | |
| | CGTGTCACCATGCTGCGTGACACCTCCAAAAATCAATT | | LRLSSVTAADTA | |
| | CTCCCTGCGCCTGAGCTCTGTGACGGCGGCCGACACTG | | VYYCARSLARTT | |
| | CGGTGTACTACTGCGCTCGCAGCCTGGCGCGTACCACT | | AMDYWGQGSLV | |
| | GCTATGGATTACTGGGGTCAGGCAGCCTGGTAACCGT | | TVSSGGTSESATP | |
| | CAGCAGCGGAGGTACTTCTGAAAGCGCTACTCCGGAGT | | ESGPGTSTEPSEG | |
| | CCGGTCCAGGTACCTCTACCGAACCGTCCGAAGGCAGC | | SAPGTSTEPSEGS | |
| | GCTCCAGGTACTTCTGAACCTTCTGAGGGTAGCGCTCCT | | APGTSESATPESG | |
| | CCAGGTACTTCTGAAAGCGCTACTCCGGAGTCCGGTCC | | PGTSTEPSEGSAP | |
| | AGGTACCTCTACCGAACCGTCCGAAGGCAGCGCTCCAG | | GTSTEPSEGSAPG | |
| | GTACTTCTACTGAACCTTCTGAGGGTAGCGCTCCAGGT | | TSESATPESGPGT | |
| | ACCTCTGAAAGCGCTACTCCGGAGTCTGGCCCAGGTAC | | STEPSEGSAPGTS | |
| | CTCTACTGAACCGTCTGAGGGTAGCGCTCCAGGTACTT | | TEPSEGSAPGTST | |
| | CTACTGAACCGTCCGAAGGTAGCGCACCAGGTACTTCT | | EPSEGSAPGSPAG | |
| | ACCGAACCGTCCGAGGGTAGCGCACCAGGTAGCCCAGC | | SPTSTEEGTSTEPS | |
| | AGGTTCTCCTACCTCCACCGAGGAAGGTACTTCTACCG | | EGSAPG | |
| | AACCGTCCGAGGGTAGCGCACCAGGTTAA | | | |
| AE48-aIL6R-AE864, AC362 | ATGGCTGAACCTGCTGGCTCTCCAACCTCCACTGAGGA AGGTACCCCGGGTAGCGGTACTGCTTCTTCCTCTCCAGG TAGCTCTACCCCTTCTGGTGCAACCGGCTCTCCAGGTGC TTCTCCGGGCACCAGCTCTACCGGTTCTCCAgggtctccaggt GATATTCAAATGACTCAATCTCCTTCTTCTCTGTCCGCA TCTGTAGGCGACCGTGTAACCATCACTTGCCGTGCCTCC CAGGACATCTCCAGCTACCTGAACTGGTACCAGCAGAA | 705 | MAEPAGSPTSTEE GTPGSGTASSSPG SSTPSGATGSPGA SPGTSSTGSPGSP GDIQMTQSPSSLS ASVGDRVTITCR ASQDISSYLNWY | 730 |

TABLE 25-continued

DNA and amino acid sequences of binding fusion protein constructs

| Clone Name | DNA Sequence | SEQ ID NO: | Amino Acid Sequence | SEQ ID NO: |
|---|---|---|---|---|
| | GCCGGGCAAGGCTCCGAAACTGCTGATTTATTACACTA | | QQKPGKAPKLLI | |
| | GCCGTCTGCATTCTGGTGTTCCGAGCCGCTTCTCCGGTT | | YYTSRLHSGVPS | |
| | CTGGCAGCGGTACCGATTTCACTTTTACTATCTCCAGCC | | RFSGSGSGTDFTF | |
| | TGCAACCGGAGGACATCGCGACGTACTATTGCCAGCAA | | TISSLQPEDIATY | |
| | GGTAATACCCTGCCGTACACCTTCGGCCAAGGCACGAA | | YCQQGNTLPYTF | |
| | AGTTGAAATCAAAACCGGTTCTGGCGAAGGCTCTGAAG | | GQGTKVEIKTGS | |
| | GTGAAGGTGGTGGTGAAGGCTCTGAAGGTGAAGGATCT | | GEGSEGEGGGEG | |
| | GGTGAAGGTGGCGAAGGTGAGGGTTCTGGATCCCAAGT | | SEGEGSGEGGEG | |
| | TCAGCTGCAGGAATCTGGTCCGGGTCTGGTTCGTCCGTC | | EGSGSQVQLQES | |
| | TCAGACCCTGTCCCTGACCTGCACGGTGTCCGGCTACTC | | GPGLVRPSQTLSL | |
| | TATTCCTCTGACCGTCGTGGTCCTGGGTCCGTCAGCC | | TCTVSGYSITSDH | |
| | ACCGGGTCGCGGTCTGGAGTGGATCGGCTACATCAGCT | | AWSWVRQPPGR | |
| | ACAGCGGCATCACCACTTACAACCCGTCCCTGAAAAGC | | GLEWIGYISYSGI | |
| | CGTGTCACCATGCTGCGTGACACCTCCAAAAATCAATT | | TTYNPSLKSRVT | |
| | CTCCCTGCGCCTGAGCTCTGTGACGGCGGCCGACACTG | | MLRDTSKNQFSL | |
| | CGGTGTACTACTGCGCTCGCAGCCTGGCGCGTACCACT | | RLSSVTAADTAV | |
| | GCTATGGATTACTGGGGTCAGGGCAGCCTGGTAACCGT | | YYCARSLARTTA | |
| | CAGCAGCGGAGGTAGCCCGGCTGGCTCTCCTACCTCTA | | MDYWGQGSLVT | |
| | CTGAGGAAGGTACTTCTGAAAGCGCTACTCCTGAGTCT | | VSSGGSPAGSPTS | |
| | GGTCCAGGTACCTCTACTGAACCGTCCGAAGGTAGCGC | | TEEGTSESATPES | |
| | TCCAGGTAGCCCAGCAGGCTCTCCGACTTCCACTGAGG | | GPGTSTEPSEGSA | |
| | AAGGTACTTCTACTGAACCTTCCGAAGGCAGCGCACCA | | PGSPAGSPTSTEE | |
| | GGTACCTCTACTGAACCTTCTGAGGGCAGCGCTCCAGG | | GTSTEPSEGSAPG | |
| | TACTTCTGAAAGCGCTACCCCGGAATCTGGCCCAGGTA | | TSTEPSEGSAPGT | |
| | GCGAACCGGCTACTTCTGGTTCTGAAACCCAGGTAGC | | SESATPESGPGSE | |
| | GAACCGGCTACCTCCGGTTCTGAAACTCCAGGTAGCCC | | PATSGSETPGSEP | |
| | GGCAGGCTCTCCGACCTCTACTGAGGAAGGTACTTCTG | | ATSGSETPGSPAG | |
| | AAAGCGCAACCCCGGAGTCCGGCCCAGGTACCTCTACC | | SPTSTEEGTSESA | |
| | GAACCGTCTGAGGGCAGCGCACCAGGTACTTCTACCGA | | TPESGPGTSTEPS | |
| | ACCGTCCGAGGGTAGCGCACCAGGTAGCCCAGCAGGTT | | EGSAPGTSTEPSE | |
| | CTCCTACCTCCACCGAGGAAGGTACTTCTACCGAACCG | | GSAPGSPAGSPTS | |
| | TCCGAGGGTAGCGCACCAGGTACCTCTACTGAACCTTC | | TEEGTSTEPSEGS | |
| | TGAGGGCAGCGCTCCAGGTACTTCTGAAAGCGCTACCC | | APGTSTEPSEGSA | |
| | CGGAGTCCGGTCAGGTACTTCTACTGAACCGTCCGAA | | PGTSESATPESGP | |
| | GGTAGCGCACCAGGTACTTCTGAAAGCGCAACCCCTGA | | GTSTEPSEGSAPG | |
| | ATCCGGTCCAGGTAGCGAACCGGCTACTTCTGGCTCTG | | TSESATPESGPGS | |
| | AGACTCCAGGTACTTCTACCGAACCGTCCGAAGGTAGC | | EPATSGSETPGTS | |
| | GCACCAGGTACTTCTACTGAACCGTCTGAAGGTAGCGC | | TEPSEGSAPGTST | |
| | ACCAGGTACTTCTGAAAGCGCAACCCCGGAATCCGGCC | | EPSEGSAPGTSES | |
| | CAGGTACCTCTGAAAGCGCAACCCCGGAGTCCGGCCCA | | ATPESGPGTSESA | |
| | GGTAGCCCTGCTGGCTCTCCAACCTCCACCGAAGAAGG | | TPESGPGSPAGSP | |
| | TACCTCTGAAAGCGCAACCCCTGAATCCGGCCCAGGTA | | TSTEEGTSESATP | |
| | GCGAACCGGCAACCTCCGGTTCTGAAACCCCAGGTACC | | ESGPGSEPATSGS | |
| | TCTGAAAGCGCTACTCCGGAGTCTGGCCCAGGTACCTC | | ETPGTSESATPES | |
| | TACTGAACCGTCTGAGGGTAGCGCTCCAGGTACTTCTA | | GPGTSTEPSEGSA | |
| | CTGAACCGTCCGAAGGTAGCGCACCAGGTACTTCTACC | | PGTSTEPSEGSAP | |
| | GAACCGTCCGAAGGCAGCGCTCCAGGTACCTCTACTGA | | GTSTEPSEGSAPG | |
| | ACCTTCCGAGGGCAGCGCTCCAGGTACCTCTACCGAAC | | TSTEPSEGSAPGT | |
| | CTTCTGAAGGTAGCGCACCAGGTACTTCTACCGAACCG | | STEPSEGSAPGTS | |
| | TCCGAGGGTAGCGCACCAGGTAGCCCAGCAGGTTCTCC | | TEPSEGSAPGSPA | |
| | TACCTCCACCGAGGAAGGTACTTCTACCGAACCGTCCG | | GSPTSTEEGTSTE | |
| | AGGGTAGCGCACCAGGTACCTCTGAAAGCGCAACTCCT | | PSEGSAPGTSESA | |
| | GAGTCTGGCCCAGGTAGCGAACCTGCTACCTCCGGCTC | | TPESGPGSEPATS | |
| | TGAGACTCCAGGTACCTCTGAAAGCGCAACCCCGGAAT | | GSETPGTSESATP | |
| | CTGGTCCAGGTAGCGAACCTGCAACCTCTGGCTCTGAA | | ESGPGSEPATSGS | |
| | ACCCCAGGTACCTCTGAAAGCGCTACTCCTGAATCTGG | | ETPGTSESATPES | |
| | CCCAGGTACTTCTACTGAACCGTCCGAGGGCAGCGCAC | | GPGTSTEPSEGSA | |
| | CAGGTACTTCTGAAAGCGCTACTCCTGAGTCCGGCCCA | | PGTSESATPESGP | |
| | GGTAGCCCGGCTGGCTCTCCGACTTCCACCGAGGAAGG | | GSPAGSPTSTEEG | |
| | TAGCCCGGCTGGCTCTCCAACTTCTACTGAAGAAGGTA | | SPAGSPTSTEEGS | |
| | GCCCGGCAGGCTCTCCGACCTCTACTGAGGAAGGTACT | | PAGSPTSTEEGTS | |
| | TCTGAAAGCGCAACCCCGGAGTCCGGCCCAGGTACCTC | | ESATPESGPGTST | |
| | TACCGAACCGTCTGAGGGCAGCGCACCAGGTACCTCTG | | EPSEGSAPGTSES | |
| | AAAGCGCAACTCCTGAGTCTGGCCCAGGTAGCGAACCT | | ATPESGPGSEPAT | |
| | GCTACCTCCGGCTCTGAGACTCCAGGTACCTCTGAAAG | | SGSETPGTSESAT | |
| | CGCAACCCCGGAATCTGGTCCAGGTAGCGAACCTGCAA | | PESGPGSEPATSG | |
| | CCTCTGGCTCTGAAACCCCAGGTACCTCTGAAAGCGCT | | SETPGTSESATPE | |
| | ACTCCTGAATCTGGCCCAGGTACTTCTACTGAACCGTCC | | SGPGTSTEPSEGS | |
| | GAGGGCAGCGCACCAGGTAGCCCTGCTGGCTCTCCTACT | | APGSPAGSPTSTE | |
| | CTCCACCGAAGAAGGTACCTCTGAAAGCGCAACCCCTG | | EGTSESATPESGP | |
| | AATCCGGCCCAGGTAGCGAACCGGCAACCTCCGGTTCT | | GSEPATSGSETPG | |
| | GAAACCCCAGGTACTTCTGAAAGCGCTACTCCTGAGTC | | TSESATPESGPGS | |
| | CGGCCCAGGTAGCCCGGCTGGCTCTCCGACTTCCACCG | | PAGSPTSTEEGSP | |
| | AGGAAGGTAGCCCGGCTGGCTCTCCAACTTCTACTGAA | | AGSPTSTEEGTST | |

TABLE 25-continued

DNA and amino acid sequences of binding fusion protein constructs

| Clone Name | DNA Sequence | SEQ ID NO: | Amino Acid Sequence | SEQ ID NO: |
|---|---|---|---|---|
| | GAAGGTACTTCTACCGAACCTTCCGAGGGCAGCGCACC<br>AGGTACTTCTGAAAGCGCTACCCCTGAGTCCGGCCCAG<br>GTACTTCTGAAAGCGCTACTCCTGAATCCGGTCCAGGT<br>ACTTCTGAAAGCGCTACCCCGGAATCTGGCCCAGGTAG<br>CGAACCGGCTACTTCTGGTTCTGAAACCCCAGGTAGCG<br>AACCGGCTACCTCCGGTTCTGAAACTCCAGGTAGCCA<br>GCAGGCTCTCCGACTTCCACTGAGGAAGGTACTTCTAC<br>TGAACCTTCCGAAGGCAGCGCACCAGGTACCTCTACTG<br>AACCTTCTGAGGGCAGCGCTCCAGGTAGCGAACCTGCA<br>ACCTCTGGCTCTGAAACCCCAGGTACCTCTGAAAGCGC<br>TACTCCTGAATCTGGCCCAGGTACTTCTACTGAACCGTC<br>CGAGGGCAGCGCACCAGGTTAA | | EPSEGSAPGTSES<br>ATPESGPGTSESA<br>TPESGPGTSESAT<br>PESGPGSEPATSG<br>SETPGSEPATSGS<br>ETPGSPAGSPTST<br>EEGTSTEPSEGSA<br>PGTSTEPSEGSAP<br>GSEPATSGSETPG<br>TSESATPESGPGT<br>STEPSEGSAPG | |
| anti-<br>CD40-<br>AE864,<br>AC384 | ATGGCTGAAATTGTTCTGACCCAATCTCCTGCAACTCTG<br>TCTCTGTCTCCAGGTGAACGCGCCACCCTGTCTTGTCGT<br>GCGTCCCAGTCTATCTCTGATTATCTGCATTGGTATCAG<br>CAGAAACCTGGCCAGGCTCCGCGCCTGCTGATCTATTA<br>CGCCAGCCACAGCATCTCTGGTATCCCGGCTCGCTTCTC<br>CGGCTCCGGCAGCGGCACCGACTTCACTCTGACTATTA<br>GCTCCCTGGAACCGGAGGATTTCGCAGTTTATTACTGTC<br>AGCACGGTCACTCCTACCCGTGGACCTTTGGTGGCGGC<br>ACCAAAGTTGAAATCAAAACCGGTTCTGGCGAAGGCTC<br>TGAAGGTGAAGGTGGTGGTGAAGGCTCTGAAGGTGAA<br>GGATCTGGTGAAGGTGGCGAAGGTGAGGGATCTGGTAC<br>CCAAGTCCAGCTGGTTCAGTCCGGCTCTGAACTGAAGA<br>AACCGGGCGCTTCTGTTAAAGTTAGCTGCAAAGCAAGC<br>GGTTATGCCTTTACTACTACTGGTATGCAGTGGGTCCGC<br>CAGGCACCGGGTCAGGGCCTGGAGTGGATGGGCTGGAT<br>CAACACCCACTCTGGTGTCCCTAAATACGTTGAAGATTT<br>CAAAGGCCGTTTCGTGTTCTCCCTGGACACTTCCGTCAG<br>CACCGCGTATCTGCAGATCAGCAGCCTGAAAGCTGAGG<br>ACACCGCGGTTTATTACTGCGCGTAGCGGCAATGGT<br>AACTACGACCTGGCTTATTTCAAATACTGGGGTCAGGG<br>CACTCTGGTTACTGTGTCTAGCGGAGGTAGCCCGGCTG<br>GCTCTCCTACCTCTACTGAGGAAGGTACTTCTGAAAGC<br>GCTACTCCTGAGTCTGGTCCAGGTACCTCTACTGAACCG<br>TCCGAAGGTAGCGCTCCAGGTAGCCCAGCAGGCTCTCC<br>GACTTCCACTGAGGAAGGTACTTCTACTGAACCTTCCG<br>AAGGCAGCGCACCAGGTACCTCTACTGAACCTTCTGAG<br>GGCAGCGCTCCAGGTACTTCTGAAAGCGCTACCCCGGA<br>ATCTGGCCCAGGTAGCGAACCGGCTACTTCTGGTTCTG<br>AAACCCCAGGTAGCGAACCGGCTACCTCCGGTTCTGAA<br>ACTCCAGGTAGCCCGGCAGGCTCTCCGACCTCTACTGA<br>GGAAGGTACTTCTGAAAGCGCAACCCCGGAGTCCGGCC<br>CAGGTACCTCTACCGAACCGTCTGAGGGCAGCGCACCA<br>GGTACTTCTACCGAACCGTCCGAGGGTAGCGCACCAGG<br>TAGCCCAGCAGGTTCTCCTACCTCCACCGAGGAAGGTA<br>CTTCTACCGAACCGTCCGAGGGTAGCGCACCAGGTACC<br>TCTACTGAACCTTCTGAGGGCAGCGCTCCAGGTACTTCT<br>GAAAGCGCTACCCCGGAGTCCGGTCCAGGTACTTCTAC<br>TGAACCGTCCGAAGGTAGCGCACCAGGTACTTCTGAAA<br>GCGCAACCCCTGAATCCGGTCCAGGTAGCGAACCGGCT<br>ACTTCTGGCTCTGAGACTCCAGGTACTTCTACCGAACCG<br>TCCGAAGGTAGCGCACCAGGTACTTCTACTGAACCGTC<br>TGAAGGTAGCGCACCAGGTACTTCTGAAAGCGCAACCC<br>CGGAATCCGGCCCAGGTACCTCTGAAAGCGCAACCCCG<br>GAGTCCGGCCCAGGTAGCCCTGCTGGCTCTCCAACCTC<br>CACCGAAGAAGGTACCTCTGAAAGCGCAACCCCTGAAT<br>CCGGCCCAGGTAGCGAACCGGCAACCTCCGGTTCTGAA<br>ACCCCAGGTACCTCTGAAAGCGCTACTCCGGAGTCTGG<br>CCCAGGTACCTCTACTGAACCGTCTGAGGGTAGCGCTC<br>CAGGTACTTCTACTGAACCGTCCGAAGGTAGCGCACCA<br>GGTACTTCTACCGAACCGTCCGAAGGCAGCGCTCCAGG<br>TACCTCTACTGAACCTTCCGAGGGCAGCGCTCCAGGTA<br>CCTCTACCGAACCTTCTGAAGGTAGCGCACCAGGTACT<br>TCTACCGAACCGTCCGAGGGTAGCGCACCAGGTAGCCC<br>AGCAGGTTCTCCTACCTCCACCGAGGAAGGTACTTCTA<br>CCGAACCGTCCGAGGGTAGCGCACCAGGTACCTCTGAA<br>AGCGCAACTCCTGAGTCCGGCCCAGGTAGCGAACCTGC<br>TACCTCCGGCTCTGAGACTCCAGGTACCTCTGAAAGCG<br>CAACCCCGGAATCTGGTCCAGGTAGCGAACCTGCAACC<br>TCTGGCTCTGAAACCCCAGGTACCTCTGAAAGCGCTAC<br>TCCTGAATCTGGCCCAGGTACTTCTACTGAACCGTCCGA<br>GGGCAGCGCACCAGGTACTTCTGAAAGCGCTACTCCTG | 706 | MAEIVLTQSPATL<br>SLSPGERATLSCR<br>ASQSISDYLHWY<br>QQKPGQAPRLLI<br>YYASHSISGIPAR<br>FSGSGSGTDFTLT<br>ISSLEPEDFAVYY<br>CQHGHSYPWTFG<br>GGTKVEIKTGSG<br>EGSEGEGGGEGS<br>EGEGSGEGGGEGE<br>GSGTQVQLVQSG<br>SELKKPGASVKV<br>SCKASGYAFTTT<br>GMQWVRQAPGQ<br>GLEWMGWINTH<br>SGVPKYVEDFKG<br>RFVFSLDTSVSTA<br>YLQISSLKAEDTA<br>VYYCARSGNGN<br>YDLAYFKYWGQ<br>GTLVTVSSGGSP<br>AGSPTSTEEGTSE<br>SATPESGPGTSTE<br>PSEGSAPGSPAGS<br>PTSTEEGTSTEPS<br>EGSAPGTSESATP<br>ESGPGSEPATSGSE<br>SGPGSEPATSGSE<br>TPGSEPATSGSET<br>PGSPAGSPTSTEE<br>GTSESATPESGPG<br>TSTEPSEGSAPGT<br>STEPSEGSAPGSP<br>AGSPTSTEEGTST<br>EPSEGSAPGTSTE<br>PSEGSAPGTSESA<br>TPESGPGTSTEPS<br>EGSAPGTSESATP<br>ESGPGSEPATSGS<br>ETPGTSTEPSEGS<br>APGTSTEPSEGSA<br>PGTSESATPESGP<br>GTSESATPESGPG<br>SPAGSPTSTEEGT<br>SESATPESGPGSE<br>PATSGSETPGTSE<br>SATPESGPGTSTE<br>PSEGSAPGTSTEP<br>SEGSAPGTSTEPS<br>EGSAPGTSTEPSE<br>GSAPGTSTEPSEG<br>SAPGTSTEPSEGS<br>APGSPAGSPTSTE<br>EGTSTEPSEGSAP<br>GTSESATPESGPG<br>SEPATSGSETPGT<br>SESATPESGPGSE<br>PATSGSETPGTSE<br>SATPESGPGTSTE<br>PSEGSAPGTSESA | 731 |

TABLE 25-continued

DNA and amino acid sequences of binding fusion protein constructs

| Clone Name | DNA Sequence | SEQ ID NO: | Amino Acid Sequence | SEQ ID NO: |
|---|---|---|---|---|
| | AGTCCGGCCCAGGTAGCCCGGCTGGCTCTCCGACTTCC | | TPESGPGSPAGSP | |
| | ACCGAGGAAGGTAGCCCGGCTGGCTCTCCAACTTCTAC | | TSTEEGSPAGSPT | |
| | TGAAGAAGGTAGCCCGGCAGGCTCTCCGACCTCTACTG | | STEEGSPAGSPTS | |
| | AGGAAGGTACTTCTGAAAGCGCAACCCCGGAGTCCGGC | | TEEGTSESATPES | |
| | CCAGGTACCTCTACCGAACCGTCTGAGGGCAGCGCACC | | GPGTSTEPSEGSA | |
| | AGGTACCTCTGAAAGCGCAACTCCTGAGTCTGGCCCAG | | PGTSESATPESGP | |
| | GTAGCGAACCTGCTACCTCCGGCTCTGAGACTCCAGGT | | GSEPATSGSETPG | |
| | ACCTCTGAAAGCGCAACCCCGGAATCTGGTCCAGGTAG | | TSESATPESGPGS | |
| | CGAACCTGCAACCTCTGGCTCTGAAACCCCAGGTACCT | | EPATSGSETPGTS | |
| | CTGAAAGCGCTACTCCTGAATCTGGCCCAGGTACTTCT | | ESATPESGPGTST | |
| | ACTGAACCGTCCGAGGGCGCACCAGGTAGCCCTGC | | EPSEGSAPGSPAG | |
| | TGGCTCTCCAACCTCCACCGAAGAAGGTACCTCTGAAA | | SPTSTEEGTSESA | |
| | GCGCAACCCCTGAATCCGGCCCAGGTAGCGAACCGGCA | | TPESGPGSEPATS | |
| | ACCTCCGGTTCTGAAACCCCAGGTACTTCTGAAAGCGC | | GSETPGTSESATP | |
| | TACTCCTGAGTCGGCCCAGGTAGCCCGGCTGGCTCTC | | ESGPGSPAGSPTS | |
| | CGACTTCCACCGAGGAAGGTAGCCCGGCTGGCTCTCCA | | TEEGSPAGSPTST | |
| | ACTTCTACTGAAGAAGGTACTTCTACCGAACCTTCCGA | | EEGTSTEPSEGSA | |
| | GGGCAGCGCACCAGGTACTTCTGAAAGCGCTACCCCTG | | PGTSESATPESGP | |
| | AGTCCGGCCCAGGTACTTCTGAAAGCGCTACTCCTGAA | | GTSESATPESGPG | |
| | TCCGGTCCAGGTACTTCTGAAAGCGCTACCCCGGAATC | | TSESATPESGPGS | |
| | TGGCCCAGGTAGCGAACCGGCTACTTCTGGTTCTGAAA | | EPATSGSETPGSE | |
| | CCCCAGGTAGCGAACCGGCTACCTCCGGTTCTGAAACT | | PATSGSETPGSPA | |
| | CCAGGTAGCCCAGCAGGCTCTCCGACTTCCACTGAGGA | | GSPTSTEEGTSTE | |
| | AGGTACTTCTACTGAACCTTCCGAAGGCAGCGCACCAG | | PSEGSAPGTSTEP | |
| | GTACCTCTACTGAACCTTCTGAGGGCAGCGCTCCAGGT | | SEGSAPGSEPATS | |
| | AGCGAACCTGCAACCTCTGGCTCTGAAACCCCAGGTAC | | GSETPGTSESATP | |
| | CTCTGAAAGCGCTACTCCTGAATCTGGCCCAGGTACTTC | | ESGPGTSTEPSEG | |
| | TACTGAACCGTCCGAGGGCAGCGCACCA | | SAP | |
| anti-CD40-AE864, AC385 | ATGGCTGAAATTGTTCTGACTCAATCTCCAGCAACTCTG | 707 | MAEIVLTQSPATL | 732 |
| | TCTCTGTCTCCAGGTGAACGTGCAACCCTGTCTTGCCGT | | SLSPGERATLSCR | |
| | GCGTCCCAGTCCATCTCCGATTATCTGCATTGGTATCAG | | ASQSISDYLHWY | |
| | CAGAAACCGGGTCAGGCGCCTCGTCTGCTGATCTATTA | | QQKPGQAPRLLI | |
| | TGCGTCTCACTCCATTTCCGGTATCCCGGCACGTTTCTC | | YYASHSISGIPAR | |
| | TGGCAGCGGCAGCGGCACCGATTTCACCCTGACGATCT | | FSGSGSGTDFTLT | |
| | CTTCTCTGGAACCGGAAGATTTCGCAGTCTATTATTGTC | | ISSLEPEDFAVYY | |
| | AGCATGGTCACAGCTACCCGTGGACCTTCGGCGGTGGC | | CQHGHSYPWTFG | |
| | ACGAAAGTTGAAATCAAGACCGGTTCTGGCGAAGGCTC | | GGTKVEIKTGSG | |
| | TGAAGGTGAAGGTGGTGGTGAAGGCTCTGAAGGTGAA | | EGSEGEGGGEGS | |
| | GGATCTGGTGAAGGTGGCGAAGGTGAGGGATCTGGTAC | | EGEGSGEGGGEGE | |
| | CCAGGTCCAGCTGGTTCAAAGCGGCTCTGAACTGAAAA | | GSGTQVQLVQSG | |
| | AGCCGGGTGCCTCTGTCAAAGTGTCTTGCAAGGCAAGC | | SELKPGASVKV | |
| | GGCTACGCGTTTACGACCACCGGCATGCAGTGGGTCCG | | SCKASGYAFTTT | |
| | TCAGGCCCCGGCCAGGGTCTGGAATGGATGGGCTGGA | | GMQWVRQAPGQ | |
| | TCAACACCCATTCTGGCGTACCGAAATACGTTGAAGAT | | GLEWMGWINTH | |
| | TTCAAAGGCCGTTTCGTGTTCTCCCTGGATACGTCCGTT | | SGVPKYVEDFKG | |
| | TCCACCGCCTACCTGCAGATCTCTTCCCTGAAAGCAGA | | RFVFSLDTSVSTA | |
| | AGATACTGCCGTGTACTATTGCGCACGTAGCGGCAACG | | YLQISSLKAEDTA | |
| | GCAACTACGACCTGGCCTACTTCAAATACTGGGGTCAG | | VYYCARSGNGN | |
| | GGTACTCTGGTGACCGTATCCTCTGGAGGTAGCCCGGC | | YDLAYFKYWGQ | |
| | TGGCTCTCCTACCTCTACTGAGGAAGGTACTTCTGAAA | | GTLVTVSSGGSP | |
| | GCGCTACTCCTGAGTCTGGTCCAGGTACCTCTGAAC | | AGSPTSTEEGTSE | |
| | CGTCCGAAGGTAGCGCTCCAGGTAGCCCAGCAGGCTCT | | SATPESGPGTSTE | |
| | CCGACTTCCACTGAGGAAGGTACTTCTACTGAACCTTCC | | PSEGSAPGSPAGS | |
| | GAAGGCAGCGCACCAGGTACCTCTACTGAACCTTCTGA | | PTSTEEGTSTEPS | |
| | GGGCAGCGCTCCAGGTACTTCTGAAAGCGCTACCCCGG | | EGSAPGTSTEPSE | |
| | AATCTGGCCCAGGTAGCGAACCGGCTACTTCTGGTTCT | | GSAPGTSESATPE | |
| | GAAACCCCAGGTAGCGAACCGGCTACCTCCGGTTCTGA | | SGPGSEPATSGSE | |
| | AACTCCAGGTAGCCCGGCAGGCTCTCCGACCTCTACTG | | TPGSEPATSGSET | |
| | AGGAAGGTACTTCTGAAAGCGCAACCCCGGAGTCCGGC | | PGSPAGSPTSTEE | |
| | CCAGGTACCTCTACCGAACCGTCTGAGGGCAGCGCACC | | GTSESATPESGPG | |
| | AGGTACTTCTACCGAACCGTCCGAGGGTAGCGCACCAG | | TSTEPSEGSAPGT | |
| | GTAGCCCAGCAGGTTCTCCTACCTCCACCGAGGAAGGT | | STEPSEGSAPGSP | |
| | ACTTCTACCGAACCGTCCGAGGGTAGCGCACCAGGTAC | | AGSPTSTEEGTST | |
| | CTCTACTGAACCTTCTGAGGGCAGCGCTCCAGGTACTTC | | EPSEGSAPGTSTE | |
| | TGAAAGCGCTACCCCGGAGTCCGGTCCAGGTACTTCTA | | PSEGSAPGTSESA | |
| | CTGAACCGTCCGAAGGTAGCGCACCAGGTACTTCTGAA | | TPESGPGTSTEPS | |
| | AGCGCAACCCCTGAATCCGGCCCAGGTAGCGAACCGGC | | EGSAPGTSESATP | |
| | TACTTCTGGCTCTGAGACTCCAGGTACTTCTACCGAACC | | ESGPGSEPATSGS | |
| | GTCCGAAGGTAGCGCACCAGGTACTTCTACTGAACCGT | | ETPGTSTEPSEGS | |
| | CTGAAGGTAGCGCACCAGGTACTTCTGAAAGCGCAACC | | APGTSTEPSEGSA | |
| | CCGGAATCCGGCCCAGGTACCTCTGAAAGCGCAACCCC | | PGTSESATPESGP | |
| | GGAGTCCGGCCCAGGTAGCCCTGCTGGCTCTCCAACCT | | GTSESATPESGPG | |
| | CCACCGAAGAAGGTACCTCTGAAAGCGCAACCCCTGAA | | SPAGSPTSTEEGT | |

TABLE 25-continued

DNA and amino acid sequences of binding fusion protein constructs

| Clone Name | DNA Sequence | SEQ ID NO: | Amino Acid Sequence | SEQ ID NO: |
|---|---|---|---|---|
| | TCCGGCCCAGGTAGCGAACCGGCAACCTCCGGTTCTGA | | SESATPESGPGSE | |
| | AACCCCAGGTACCTCTGAAAGCGCTACTCCGGAGTCTG | | PATSGSETPGTSE | |
| | GCCCAGGTACCTCTACTGAACCGTCTGAGGGTAGCGCT | | SATPESGPGTSTE | |
| | CCAGGTACTTCTACTGAACCGTCCGAAGGTAGCGCACC | | PSEGSAPGTSTEP | |
| | AGGTACTTCTACCGAACCGTCCGAAGGCAGCGCTCCAG | | SEGSAPGTSTEPS | |
| | GTACCTCTACTGAACCTTCCGAGGGCAGCGCTCCAGGT | | EGSAPGTSTEPSE | |
| | ACCTCTACCGAACCTTCTGAAGGTAGCGCACCAGGTAC | | GSAPGTSTEPSEG | |
| | TTCTACCGAACCGTCCGAGGGTAGCGCACCAGGTAGCC | | SAPGTSTEPSEGS | |
| | CAGCAGGTTCTCCTACCTCCACCGAGGAAGGTACTTCT | | APGSPAGSPTSTE | |
| | ACCGAACCGTCCGAGGGTAGCGCACCAGGTACCTCTGA | | EGTSTEPSEGSAP | |
| | AAGCGCAACTCCTGAGTCTGGCCCAGGTAGCGAACCTG | | GTSESATPESGPG | |
| | CTACCTCCGGCTCTGAGACTCCAGGTACCTCTGAAAGC | | SEPATSGSETPGT | |
| | GCAACCCCGGAATCTGGTCCAGGTAGCGAACCTGCAAC | | SESATPESGPGSE | |
| | CTCTGGCTCTGAAACCCCAGGTACCTCTGAAAGCGCTA | | PATSGSETPGTSE | |
| | CTCCTGAATCTGGCCCAGGTACTTCTACTGAACCGTCCG | | SATPESGPGTSTE | |
| | AGGGCAGCGCACCAGGTACTTCTGAAAGCGCTACTCCT | | PSEGSAPGTSESA | |
| | GAGTCCGGCCCAGGTAGCCCGGCTGGCTCTCCGACTTC | | TPESGPGSPAGSP | |
| | CACCGAGGAAGGTAGCCCGGCTGGCTCTCCAACTTCTA | | TSTEEGSPAGSPT | |
| | CTGAAGAAGGTAGCCCGGCAGGCTCTCCGACCTCTACT | | STEEGSPAGSPTS | |
| | GAGGAAGGTACTTCTGAAAGCGCAACCCCGGAGTCCGG | | TEEGTSESATPES | |
| | CCCAGGTACCTCTACCGAACCGTCTGAGGGCAGCGCAC | | GPGTSTEPSEGSA | |
| | CAGGTACCTCTGAAAGCGCAACTCCTGAGTCTGGCCCA | | PGTSESATPESGP | |
| | GGTAGCGAACCTGCTACCTCCGGCTCTGAGACTCCAGG | | GSEPATSGSETPG | |
| | TACCTCTGAAAGCGCAACCCCGGAATCTGGTCCAGGTA | | TSESATPESGPGS | |
| | GCGAACCTGCAACCTCTGGCTCTGAAACCCCAGGTACC | | EPATSGSETPGTS | |
| | TCTGAAAGCGCTACTCCTGAATCTGGCCCAGGTACTTCT | | ESATPESGPGTST | |
| | ACTGAACCGTCCGAGGCAGCGCACCAGGTAGCCCTGC | | EPSEGSAPGSPAG | |
| | TGGCTCTCCAACCTCCACCGAAGAAGGTACCTCTGAAA | | SPTSTEEGTSESA | |
| | GCGCAACCCCTGAATCCGGCCCAGGTAGCGAACCGGCA | | TPESGPGSEPATS | |
| | ACCTCCGGTTCTGAAACCCCAGGTACTTCTGAAAGCGC | | GSETPGTSESATP | |
| | TACTCCTGAGTCCGGCCCAGGTAGCCCGGCTGGCTCTC | | ESGPGSPAGSPTS | |
| | CGACTTCCACCGAGGAAGGTAGCCCGGCTGGCTCTCCA | | TEEGSPAGSPTST | |
| | ACTTCTACTGAAGAAGGTACTTCTACCGAACCTTCCGA | | EEGTSTEPSEGSA | |
| | GGGCAGCGCACCAGGTACTTCTGAAAGCGCTACCCCTG | | PGTSESATPESGP | |
| | AGTCCGGCCCAGGTACTTCTGAAAGCGCTACTCCTGAA | | GTSESATPESGPG | |
| | TCCGGTCCAGGTACTTCTGAAAGCGCTACCCCGGAATC | | TSESATPESGPGS | |
| | TGGCCCAGGTAGCGAACCGGCTACTTCTGGTTCTGAAA | | EPATSGSETPGSE | |
| | CCCCAGGTAGCGAACCGGCTACCTCCGGTTCTGAAACT | | PATSGSETPGSPA | |
| | CCAGGTAGCCCAGCAGGCTCTCCGACTTCCACTGAGGA | | GSPTSTEEGTSTE | |
| | AGGTACTTCTACTGAACCTTCCGAAGGCAGCGCACCAG | | PSEGSAPGTSTEP | |
| | GTACCTCTACTGAACCTTCTGAGGGCAGCGCTCCAGGT | | SEGSAPGSEPATS | |
| | AGCGAACCTGCAACCTCTGGCTCTGAAACCCCAGGTAC | | GSETPGTSESATP | |
| | CTCTGAAAGCGCTACTCCTGAATCTGGCCCAGGTACTTC | | ESGPGTSTEPSEG | |
| | TACTGAACCGTCCGAGGGCAGCGCACCA | | SAP | |
| AE912-anti-CD40, AC386 | ATGGCTGAACCTGCTGGCTCTCCAACCTCCACTGAGGA | 708 | MAEPAGSPTSTEE | 733 |
| | AGGTACCCCGGGTAGCGGTACTGCTTCTTCCTCTCCAGG | | GTPGSGTASSSPG | |
| | TAGCTCTACCCCTTCTGGTGCAACCGGCTCTCCAGGTGC | | SSTPSGATGSPGA | |
| | TTCTCCGGGCACCAGCTCTACCGGTTCTCCAGGTAGCCC | | SPGTSSTGSPGSP | |
| | GGCTGGCTCTCCTACCTCTACTGAGGAAGGTACTTCTGA | | AGSPTSTEEGTSE | |
| | AAGCGCTACTCCTGAGTCTGGTCCAGGTACCTCTACTG | | SATPESGPGTSTE | |
| | AACCGTCCGAAGGTAGCGCTCCAGGTAGCCCAGCAGGC | | PSEGSAPGSPAGS | |
| | TCTCCGACTTCCACTGAGGAAGGTACTTCTACTGAACCT | | PTSTEEGTSTEPS | |
| | TCCGAAGGCAGCGCACCAGGTACCTCTACTGAACCTTC | | EGSAPGTSTEPSE | |
| | TGAGGGCAGCGCTCCAGGTACTTCTGAAAGCGCTACCC | | GSAPGTSESATPE | |
| | CGGAATCTGGCCCAGGTAGCGAACCGGCTACTTCTGGT | | SGPGSEPATSGSE | |
| | TCTGAAACCCCAGGTAGCGAACCGGCTACCTCCGGTTC | | TPGSEPATSGSET | |
| | TGAAACTCCAGGTAGCCCGGCAGGCTCTCCGACCTCTA | | PGSPAGSPTSTEE | |
| | CTGAGGAAGGTACTTCTGAAAGCGCAACCCCGGAGTCC | | GTSESATPESGPG | |
| | GGCCCAGGTACCTCTACCGAACCGTCTGAGGGCAGCGC | | TSTEPSEGSAPGT | |
| | ACCAGGTACTTCTACCGAACCGTCGGAGGGTAGCGCGSP | | STEPSEGSAPGSP | |
| | CAGGTAGCCCAGCAGGTTCTCCTACCTCCACCGAGGAA | | AGSPTSTEEGTST | |
| | GGTACTTCTACCGAACCGTCCGAGGGTAGCGCACCAGG | | EPSEGSAPGTSTE | |
| | TACCTCTACTGAACCTTCTGAGGGCAGCGCTCCAGGTA | | PSEGSAPGTSESA | |
| | CTTCTGAAAGCGCTACCCCGGAGTCCGGTCCAGGTACT | | TPESGPGTSTEPS | |
| | TCTACTGAACCGTCCGAAGGTAGCGCACCAGGTACTTC | | EGSAPGTSESATP | |
| | TGAAAGCGCAACCCCTGAATCCGGTCCAGGTAGCGAAC | | ESGPGSEPATSGS | |
| | CGGCTACTTCTGGCTCTGAGACTCCAGGTACTTCTACCG | | ETPGTSTEPSEGS | |
| | AACCGTCCGAAGGTAGCGCACCAGGTACTTCTACTGAA | | APGTSTEPSEGSA | |
| | CCGTCTGAAGGTAGCGCACCAGGTACTTCTGAAAGCGC | | PGTSESATPESGP | |
| | AACCCCGGAATCGGCCCAGGTACCTCTGAAAGCGCAA | | GTSESATPESGPG | |
| | CCCCGGAGTCCGGCCCAGGTAGCCCTGCTGGCTCTCCA | | SPAGSPTSTEEGT | |
| | ACTCCACCGAAGAAGGTACCTCTGAAAGCGCAACCCC | | SESATPESGPGSE | |
| | TGAATCCGGCCCAGGTAGCGAACCGGCAACCTCCGGTT | | PATSGSETPGTSE | |

TABLE 25-continued

DNA and amino acid sequences of binding fusion protein constructs

| Clone Name | DNA Sequence | SEQ ID NO: | Amino Acid Sequence | SEQ ID NO: |
|---|---|---|---|---|
| | CTGAAACCCCAGGTACCTCTGAAAGCGCTACTCCGGAG | | SATPESGPGTSTE | |
| | TCTGGCCCAGGTACCTCTACTGAACCGTCTGAGGGTAG | | PSEGSAPGTSTEP | |
| | CGCTCCAGGTACTTCTACTGAACCGTCCGAAGGTAGCG | | SEGSAPGTSTEPS | |
| | CACCAGGTACTTCTACCGAACCGTCCGAAGGCAGCGCT | | EGSAPGTSTEPSE | |
| | CCAGGTACCTCTACTGAACCTTCCGAGGGCAGCGCTCC | | GSAPGTSTEPSEG | |
| | AGGTACCTCTACCGAACCTTCTGAAGGTAGCGCACCAG | | SAPGTSTEPSEGS | |
| | GTACTTCTACCGAACCGTCCGAGGGTAGCGCACCAGGT | | APGSPAGSPTSTE | |
| | AGCCCAGCAGGTTCTCCTACCTCCACCGAGGAAGGTAC | | EGTSTEPSEGSAP | |
| | TTCTACCGAACCGTCCGAGGGTAGCGCACCAGGTACCT | | GTSESATPESGPG | |
| | CTGAAAGCGCAACTCCTGAGTCTGGCCCAGGTAGCGAA | | SEPATSGSETPGT | |
| | CCTGCTACCTCCGGCTCTGAGACTCCAGGTACCTCTGAA | | SESATPESGPGSE | |
| | AGCGCAACCCCGGAATCTGGTCAGGTAGCGAACCTGC | | PATSGSETPGTSE | |
| | AACCTCTGGCTCTGAAACCCCAGGTACCTCTGAAAGCG | | SATPESGPGTSTE | |
| | CTACTCCTGAATCTGGCCCAGGTACTTCTACTGAACCGT | | PSEGSAPGTSESA | |
| | CCGAGGGCAGCGCACCAGGTACTTCTGAAAGCGCTACT | | TPESGPGSPAGSP | |
| | CCTGAGTCCGGCCCAGGTAGCCCGGCTGGCTCTCCGAC | | TSTEEGSPAGSPT | |
| | TTCCACCGAGGAAGGTAGCCCGGCTGGCTCTCCAACTT | | STEEGSPAGSPTS | |
| | CTACTGAAGAAGGTAGCCCGGCAGGCTCTCCGACCTCT | | TEEGTSESATPES | |
| | ACTGAGGAAGGTACTTCTGAAAGCGCAACCCCGGAGTC | | GPGTSTEPSEGSA | |
| | CGGCCCAGGTACCTCTACCGAACCGTCTGAGGGCAGCG | | PGTSESATPESGP | |
| | CACCAGGTACCTCTGAAAGCGCAACTCCTGAGTCTGGC | | GSEPATSGSETPG | |
| | CCAGGTAGCGAACCTGCTACCTCCGGCTCTGAGACTCC | | TSESATPESGPGS | |
| | AGGTACCTCTGAAAGCGCAACCCCGGAATCTGGTCCAG | | EPATSGSETPGTS | |
| | GTAGCGAACCTGCAACCTCTGGCTCTGAAACCCCAGGT | | ESATPESGPGTST | |
| | ACCTCTGAAAGCGCTACTCCTGAATCTGGCCCAGGTAC | | EPSEGSAPGSPAG | |
| | TTCTACTGAACCGTCCGAGGGCAGCGCACCAGGTAGCC | | SPTSTEEGTSESA | |
| | CTGCTGGCTCTCCAACCTCCACCGAAGAAGGTACCTCT | | TPESGPGSEPATS | |
| | GAAAGCGCAACCCCTGAATCCGGCCCAGGTAGCGAACC | | GSETPGTSESATP | |
| | GGCAACCTCCGGTTCTGAAACCCCAGGTACTTCTGAAA | | ESGPGSPAGSPTS | |
| | GCGCTACTCCTGAGTCCGGCCCAGGTAGCCCGGCTGGC | | TEEGSPAGSPTST | |
| | TCTCCGACTTCCACCGAGGAAGGTAGCCCGGCTGGCTC | | EEGTSTEPSEGSA | |
| | TCCAACTTCTACTGAAGAAGGTACTTCTACCGAACCTTC | | PGTSESATPESGP | |
| | CGAGGGCAGCGCACCAGGTACTTCTGAAAGCGCTACCC | | GTSESATPESGPG | |
| | CTGAGTCCGGCCCAGGTACTTCTGAAAGCGCTACTCCT | | TSESATPESGPGS | |
| | GAATCCGGTCCAGGTACTTCTGAAAGCGCTACCCCGGA | | EPATSGSETPGSE | |
| | ATCTGGCCCAGGTAGCGAACCGGCTACTTCTGGTTCTG | | PATSGSETPGSPA | |
| | AAACCCCAGGTAGCGAACCGGCTACCTCCGGTTCTGAA | | GSPTSTEEGTSTE | |
| | ACTCCAGGTAGCCCAGCAGGCTCTCCGACTTCCACTGA | | PSEGSAPGTSTEP | |
| | GGAAGGTACTTCTACTGAACCTTCCGAAGGCAGCGCAC | | SEGSAPGSEPATS | |
| | CAGGTACCTCTACTGAACCTTCTGAGGGCAGCGCTCCA | | GSETPGTSESATP | |
| | GGTAGCGAACCTGCAACCTCTGGCTCTGAAACCCCAGG | | ESGPGTSTEPSEG | |
| | TACCTCTGAAAGCGCTACTCCTGAATCTGGCCCAGGTA | | SAPGEIVLTQSPA | |
| | CTTCTACTGAACCGTCCGAGGGCAGCGCACCAGGTGAA | | TLSLSPGERATLS | |
| | ATTGTTCTGACCCAATCTCCTGCAACTCTGTCTCTGTCT | | CRASQSISDYLH | |
| | CCAGGTGAACGCGCCACCCTGTCTTGTCGTGCGTCCCA | | WYQQKPGQAPR | |
| | GTCTATCTCTGATTATCTGCATTGGTATCAGCAGAAACC | | LLIYYASHSISGIP | |
| | TGGCCAGGCTCCGCGCCTGCTGATCTATTACGCCAGCC | | ARFSGSGSGTDFT | |
| | ACAGCATCTCTGGTATCCCGGCTCGCTTCTCCGGCTCCG | | LTISSLEPEDFAV | |
| | GCAGCGGCACCGACTTCACTCTGACTATTAGCTCCCTG | | YYCQHGHSYPW | |
| | GAACCGGAGGATTTCGCAGTTTATTACTGTCAGCACGG | | TFGGGTKVEIKT | |
| | TCACTCCTACCCGTGGACCTTTGGTGGCGGCACCAAAG | | GSGEGSEGEGGG | |
| | TTGAAATCAAAACCGGTTCTGGCGAAGGCTCTGAAGGT | | EGSEGEGSGEGG | |
| | GAAGGTGGTGGTGAAGGCTCTGAAGGTGAAGGATCTG | | EGEGSGTQVQLV | |
| | GTGAAGGTGGCGAAGGTGAGGGATCTGGTACCCAAGTC | | QSGSELKKPGAS | |
| | CAGCTGGTTCAGTCCGGCTCTGAACTGAAGAAACCGGG | | VKVSCKASGYAF | |
| | CGCTTCTGTTAAAGTTAGCTGCAAAGCAAGCGGTTATG | | TTTGMQWVRQA | |
| | CCTTTACTACTGGTATGCAGTGGGTCCGCCAGGCA | | PGQGLEWMGWI | |
| | CCGGGTCAGGGCTGGAGTGGATGGGCTGGATCAACAC | | NTHSGVPKYVED | |
| | CCACTCTGGTGTCCCTAAATACGTTGAAGATTTCAAAG | | FKGRFVFSLDTSV | |
| | GCCGTTTCGTGTTCTCCCTGGACACTTCCGTCAGCACCG | | STAYLQISSLKAE | |
| | CGTATCTGCAGATCAGCAGCCTGAAAGCTGAAGACACT | | DTAVYYCARSGN | |
| | GCGGTTTATTACTGCGCGCGTAGCGGCAATGGTAACTA | | GNYDLAYFKYW | |
| | CGACCTGGCTTATTTCAAATACTGGGGTCAGGGCACTC | | GQGTLVTVS | |
| | TGGTTACTGTGTCTAGC | | | |
| AE912-anti-CD40, AC387, | ATGGCTGAACCTGCTGGCTCTCCAACCTCCACTGAGGA | 709 | MAEPAGSPTSTEE | 734 |
| | AGGTACCCCGGGTAGCGGTACTGCTTCTTCCTCTCCAGG | | GTPGSGTASSSPG | |
| | TAGCTCTACCCCTTCTGGTGCAACCGGCTCTCCAGGTGC | | SSTPSGATGSPGA | |
| | TTCTCCGGGCACCAGCTCCACCGGTTCTCCAGGTAGCCC | | SPGTSSTGSPGSP | |
| | GGCTGGCTCTCCTACCTCTACTGAGGAAGGTACTTCTGA | | AGSPTSTEEGTSE | |
| | AAGCGCTACTCCTGAGTCTGGTCCAGGTACCTCTACTG | | SATPESGPGTSTE | |
| | AACCGTCCGAAGGTAGCGCTCCAGGTAGCCCAGCAGGC | | PSEGSAPGSPAGS | |
| | TCTCCGACTTCCACTGAGGAAGGTACTTCTACTGAACCT | | PTSTEEGTSTEPS | |
| | TCCGAAGGCAGCGCACCAGGTACCTCTACTGAACCTTC | | EGSAPGTSTEPSE | |

TABLE 25-continued

DNA and amino acid sequences of binding fusion protein constructs

| Clone Name | DNA Sequence | SEQ ID NO: | Amino Acid Sequence | SEQ ID NO: |
|---|---|---|---|---|
| | TGAGGGCAGCGCTCCAGGTACTTCTGAAAGCGCTACCC | | GSAPGTSESATPE | |
| | CGGAATCTGGCCCAGGTAGCGAACCGGCTACTTCTGGT | | SGPGSEPATSGSE | |
| | TCTGAAACCCCAGGTAGCGAACCGGCTACCTCCGGTTC | | TPGSEPATSGSET | |
| | TGAAACTCCAGGTAGCCCGGCAGGCTCTCCGACCTCTA | | PGSPAGSPTSTEE | |
| | CTGAGGAAGGTACTTCTGAAAGCGCAACCCCGGAGTCC | | GTSESATPESGPG | |
| | GGCCCAGGTACCTCTACCGAACCGTCTGAGGGCAGCGC | | TSTEPSEGSAPGT | |
| | ACCAGGTACTTCTACCGAACCGTCCGAGGGTAGCGCAC | | STEPSEGSAPGSP | |
| | CAGGTAGCCCAGCAGGTTCTCCTACCTCCACCGAGGAA | | AGSPTSTEEGTST | |
| | GGTACTTCTACCGAACCGTCCGAGGGTAGCGCACCAGG | | EPSEGSAPGTSTE | |
| | TACCTCTACTGAACCTTCTGAGGGCAGCGCTCCAGGTA | | PSEGSAPGTSESA | |
| | CTTCTGAAAGCGCTACCCCGGAGTCCGGTCAGGTACT | | TPESGPGTSTEPS | |
| | TCTACTGAACCGTCCGAAGGTAGCGCACCAGGTACTTC | | EGSAPGTSESATP | |
| | TGAAAGCGCAACCCCTGAATCCGGTCCAGGTAGCGAAC | | ESGPGSEPATSGS | |
| | CGGCTACTTCTGGCTCTGAGACTCCAGGTACTTCTACCG | | ETPGTSTEPSEGS | |
| | AACCGTCCGAAGGTAGCGCACCAGGTACTTCTACTGAA | | APGTSTEPSEGSA | |
| | CCGTCTGAAGGTAGCGCACCAGGTACTTCTGAAAGCGC | | PGTSESATPESGP | |
| | AACCCCGGAATCCGGCCCAGGTACCTCTGAAAGCGCAA | | GTSESATPESGPG | |
| | CCCCGGAGTCCGGCCCAGGTAGCCCTGCTGGCTCTCCA | | SPAGSPTSTEEGT | |
| | ACCTCCACCGAAGAAGGTACTTCTGAAAGCGCAACCCC | | SESATPESGPGSE | |
| | TGAATCCGGCCCAGGTAGCGAACCGGCAACCTCCGGTT | | PATSGSETPGTSE | |
| | CTGAAACCCCAGGTACCTCTGAAAGCGCTACTCCGGAG | | SATPESGPGTSTE | |
| | TCTGGCCCAGGTACCTCTACTGAACCGTCTGAGGGTAG | | PSEGSAPGTSTEP | |
| | CGCTCCAGGTACTTCTACTGAACCGTCCGAAGGTAGCG | | SEGSAPGTSTEPS | |
| | CACCAGGTACTTCTACCGAACCGTCCGAAGGCAGCGCT | | EGSAPGTSTEPSE | |
| | CCAGGTACCTCTACTGAACCTTCCGAGGGCAGCGCTCC | | GSAPGTSTEPSEG | |
| | AGGTACCTCTACCGAACCTTCTGAAGGTAGCGCACCAG | | SAPGTSTEPSEGS | |
| | GTACTTCTACCGAACCGTCGAGGGTAGCGCACCAGGT | | APGSPAGSPTSTE | |
| | AGCCCAGCAGGTTCTCCTACCTCCACCGAGGAAGGTAC | | EGTSTEPSEGSAP | |
| | TTCTACCGAACCGTCCGAGGGTAGCGCACCAGGTACCT | | GTSESATPESGPG | |
| | CTGAAAGCGCAACTCCTGAGTCTGGCCCAGGTAGCGAA | | SEPATSGSETPGT | |
| | CCTGCTACCTCCGGCTCTGAGACTCCAGGTACCTCTGAA | | SESATPESGPGSE | |
| | AGCGCAACCCCGGAATCTGGTCCAGGTAGCGAACCTGC | | PATSGSETPGTSE | |
| | AACCTCTGGCTCTGAAACCCCAGGTACCTCTGAAAGCG | | SATPESGPGTSTE | |
| | CTACTCCTGAATCTGGCCCAGGTACTTCTACTGAACCGT | | PSEGSAPGTSESA | |
| | CCGAGGGCAGCGCACCAGGTACTTCTGAAAGCGCTACT | | TPESGPGSPAGSP | |
| | CCTGAGTCCGGCCCAGGTACCTCCGGCTGGCTCTCCGAC | | TSTEEGSPAGSPT | |
| | TTCCACCGAGGAAGGTAGCCCGGCTGGCTCTCCAACTT | | STEEGSPAGSPTS | |
| | CTACTGAAGAAGGTAGCCCGGCAGGCTCTCCGACCTCT | | TEEGTSESATPES | |
| | ACTGAGGAAGGTACTTCTGAAAGCGCAACCCCGGAGTC | | GPGTSTEPSEGSA | |
| | CGGCCCAGGTACCTCTACCGAACCGTCTGAGGGCAGCGC | | PGTSESATPESGP | |
| | CACCAGGTACCTCTGAAAGCGCAACTCCTGAGTCTGGC | | GSEPATSGSETPG | |
| | CCAGGTAGCGAACCTGCTACCTCCGGCTCTGAGACTCC | | TSESATPESGPGS | |
| | AGGTACCTCTGAAAGCGCAACCCCGGAATCTGGTCCAG | | EPATSGSETPGTS | |
| | GTAGCGAACCTGCAACCTCTGGCTCTGAAACCCCAGGT | | ESATPESGPGTST | |
| | ACCTCTGAAAGCGCTACTCCTGAATCTGGCCCAGGTAC | | EPSEGSAPGSPAG | |
| | TTCTACTGAACCGTCCGAGGGCAGCGCACCAGGTAGCC | | SPTSTEEGTSESA | |
| | CTGCTGGCTCTCCAACCTCCACCGAAGAAGGTACCTCT | | TPESGPGSEPATS | |
| | GAAAGCGCAACCCCTGAATCCGGCCCAGGTAGCGAATP | | GSETPGTSESATP | |
| | GGCAACCTCCGGTTCTGAAACCCCAGGTACTTCTGAAA | | ESGPGSPAGSPTS | |
| | GCGCTACTCCTGAGTCCGGCCCAGGTAGCCCGGCTGGC | | TEEGSPAGSPTST | |
| | TCTCCGACTTCCACCGAGGAAGGTAGCCCGGCTGGCTC | | EEGTSTEPSEGSA | |
| | TCCAACTTCTACTGAAGAAGGTACTTCTACCGAACCTTC | | PGTSESATPESGP | |
| | CGAGGGCAGCGCACCAGGTACTTCTGAAAGCGCTACCC | | GTSESATPESGPG | |
| | CTGAGTCCGGCCCAGGTACTTCTGAAAGCGCTACTCCT | | TSESATPESGPGS | |
| | GAATCCGGTCCAGGTACTTCTGAAAGCGCTACCCCGGA | | EPATSGSETPGSE | |
| | ATCTGGCCCAGGTAGCGAACCGGCTACTTCTGGTTCTG | | PATSGSETPGSPA | |
| | AAACCCCAGGTAGCCCAGCAGGCTACCTCCGGTTCTGAA | | GSPTSTEEGTSTE | |
| | ACTCCAGGTAGCCCAGCAGGCTCTCCGACTTCCACTGA | | PSEGSAPGTSTEP | |
| | GGAAGGTACTTCTACTGAACCTTCCGAAGGCAGCGCAC | | SEGSAPGSEPATS | |
| | CAGGTACCTCTACTGAACCTTCTGAGGGCAGCGCTCCA | | GSETPGTSESATP | |
| | GGTAGCGAACCTGCAACCTCTGGCTCTGAAACCCCAGG | | ESGPGTSTEPSEG | |
| | TACCTCTGAAAGCGCTACTCCTGAATCTGGCCCAGGTA | | SAPGEIVLTQSPA | |
| | CTTCTACTGAACCGTCCGAGGGCAGCGCACCAGGTGAA | | TLSLSPGERATLS | |
| | ATTGTTCTGACTCAATCTCCAGCAACTCTGTCTCTGTCT | | CRASQSISDYLH | |
| | CCAGGTGAACGTGCAACCCTGTCTTGCCGTGCGTCCCA | | WYQQKPGQAPR | |
| | GTCCATCTCCGATTATCTGCATTGGTATCAGCAGAAACC | | LLIYYASHSISGIP | |
| | GGGTCAGGCGCCTCGTCTGCTGATCTATTATGCGTCTCA | | ARFSGSGSGTDFT | |
| | CTCCATTTCCGGTATCCCGGCACGTTTCTCTGGCAGCGG | | LTISSLEPEDFAV | |
| | CAGCGGCACCGATTTCACCCTGACGATCTCTTCTCTGGA | | YYCQHGHSYPW | |
| | ACCGGAAGATTTCGCAGTCTATTATTGTCAGCATGGTC | | TFGGGTKVEIKT | |
| | ACAGCTACCCGTGGACCTTCGGCGGTGGCACGAAAGTT | | GSGEGSEGEGGG | |
| | GAAATCAAGACCGGTTCTGGCGAAGGCTCTGAAGGTGA | | EGSEGEGSGEGG | |
| | AGGTGGTGGTGAAGGCTCTGAAGGTGAAGGATCTGGTG | | EGEGSGTQVQLV | |
| | AAGGTGGCGAAGGTGAGGGATCTGGTACCCAGGTCCA | | QSGSELKKPGAS | |

TABLE 25-continued

DNA and amino acid sequences of binding fusion protein constructs

| Clone Name | DNA Sequence | SEQ ID NO: | Amino Acid Sequence | SEQ ID NO: |
|---|---|---|---|---|
| | GCTGGTTCAAAGCGGCTCTGAACTGAAAAAGCCGGGTG<br>CCTCTGTCAAAGTGTCTTGCAAGGCAAGCGGCTACGCG<br>TTTACGACCACCGGCATGCAGTGGGTCCGTCAGGCCCC<br>GGGCCAGGGTCTGGAATGGATGGGCTGGATCAACACCC<br>ATTCTGGCGTACCGAAATACGTTGAAGATTTCAAAGGC<br>CGTTTCGTGTTCTCCCTGGATACGTCCGTTTCCACCGCC<br>TACCTGCAGATCTCTTCCCTGAAAGCAGAAGATACTGC<br>GGTGTACTATTGCGCACGTAGCGGCAACGGCAACTACG<br>ACCTGGCCTACTTCAAATACTGGGGTCAGGGTACTCTG<br>GTGACCGTATCCTCT | | VKVSCKASGYAF<br>TTTGMQWVRQA<br>PGQGLEWMGWI<br>NTHSGVPKYVED<br>FKGRFVFSLDTSV<br>STAYLQISSLKAE<br>DTAVYYCARSGN<br>GNYDLAYFKYW<br>GQGTLVTVS | |
| anti-<br>Her2-<br>AE864 | ATGGAAGACATTCAGATGACCCAGAGCCCGTCCTCCCT<br>GAGCGCTTCTGTTGGCGACCGCGTGACCATCACCTGCC<br>GTGCTTCCCAGGATGTTAACACCGCTGTAGCTTGGTATC<br>AACAGAAACCGGGCAAAGCACCGAAACTGCTGATCTA<br>CTCTGCTTCCTTTCTGTATAGCGGTGTTCCGTCTCGTTTC<br>AGCGGCTCTCGTAGCGGTACGGATTTTACTCTGACGAT<br>CAGCTCTCTGCAGCCGGAGGACTTCGCTACCTACTACT<br>GCCAGCAGCACTACACCACCCCGCCTACCTTGGTCAG<br>GGCACCAAAGTGGAAATCAAGACCGGTTCTGGCGAAG<br>GCTCTGAAGGTGAAGGTGGTGGTGAAGGCTCTGAAGGT<br>GAAGGATCTGGTGAAGGTGGCGAAGGTGAGGGATCTG<br>GTACCGAGGTCCAGCTGGTTGAGTCTGGCGGCGGTCTG<br>GTCCAACCTGGTGGCTCCCTGCGCCTGTCTTGCGCAGCG<br>TCCGGCTTTAATATCAAAGATACGTACATTCACTGGGTC<br>CGCCAGGCACCGGGCAAAGGCCTGGAATGGGTTGCTCG<br>TATCTACCCGACTAACGTTATACCCGTTATGCAGACA<br>GCGTAAAGGGTCGCTTCACGATCTCCGCGGATACCTCC<br>AAAAACACCGCATACCTGCAAATGAACTCTCTGCGTGC<br>GGAAGATACTGCCGTGTACTACTGCTCTCGCTGGGGCG<br>GTGACGGTTTCTATGCAATGGACTACTGGGGTCAAGGT<br>ACTCTGGTAACTGTTTCCGGGTCTCCAGGTAGCCCGGCT<br>GGCTCTCCTACCTCTACTGAGGAAGGTACTTCTGAAAG<br>CGCTACTCCTGAGTCTGGTCCAGGTACCTCTACTGAACC<br>GTCCGAAGGTAGCGCTCCAGGTAGCCCAGCAGGCTCTC<br>CGACTTCCACTGAGGAGTCCACTTCTACTGAACCTTCTGA<br>GAAGGCAGCGCACCAGGTACCTCTACTGAACCTTCTGA<br>GGGCAGCGCTCCAGGTACTTCTGAAAGCGCTACCCCGG<br>AATCTGGCCCAGGTAGCGAACCGGCTACTTCTGGTTCT<br>GAAACCCCAGGTAGCGAACCGGCTACCTCCGGTTCTGA<br>AACTCCAGGTAGCCCGGCAGGCTCTCCGACCTCTACTG<br>AGGAAGGTACTTCTGAAAGCGCAACCCCGGAGTCCGGC<br>CCAGGTACCTCTACCGAACCGTCTGAGGGCAGCGCACC<br>AGGTACTTCTACCGAACCGTCCGAGGGTAGCGCACCAG<br>GTAGCCCAGCAGGTTCTCCTACCTCCACCGAGGAAGGT<br>ACTTCTACCGAACCGTCCGAGGGTAGCGCACCAGGTAC<br>CTCTACTGAACCTTCTGAGGGCAGCGCTCCAGGTACTTC<br>TGAAAGCGCTACCCCGGAGTCCGGTCCAGGTACTTCTA<br>CTGAACCGTCCGAAGGTAGCGCACCAGGTACTTCTGAA<br>AGCGCAACCCCTGAATCGGTCAGGTAGCGAACCGGC<br>TACTTCTGGCTCTGAGACTCCAGGTACTTCTACCGAACC<br>GTCCGAAGGTAGCGCACCAGGTACTTCTACTGAACCGT<br>CTGAAGGTAGCGCACCAGGTACTTCTGAAAGCGCAACC<br>CCGGAATCCGGCCCAGGTACCTCTGAAAGCGCAACCCC<br>GGAGTCCGGCCCAGGTAGCCCTGCTGGCTCTCCAACCT<br>CCACCGAAGAAGGTACCTCTGAAAGCGCAACCCCTGAA<br>TCCGGCCCAGGTAGCGAACCGGCAACCTCCGGTTCTGA<br>AACCCCAGGTACCTCTGAAAGCGCTACTCCGGAGTCTG<br>GCCCAGGTACCTCTACTGAACCGTCTGAGGGTAGCGCT<br>CCAGGTACTTCTACTGAACCGTCCGAAGGTAGCGCACC<br>AGGTACTTCTACCGAACCGTCCGAAGGCAGCGCTCCAG<br>GTACCTCTACTGAACCTTCCGAGGGCAGCGCTCCAGGT<br>ACCTCTACCGAACCTTCTGAAGGTAGCGCACCAGGTAC<br>TTCTACCGAACCGTCCGAGGGTAGCGCACCAGGTAGCC<br>CAGCAGGTTCTCCTACCTCCGAGGAAGGTACTTCT<br>ACCGAACCGTCCGAGGGTAGCGCACCAGGTACCTCTGA<br>AAGCGCAACTCCTGAGTCTGGCCCAGGTAGCGAACCTG<br>CTACCTCCGGCTCTGAGACTCCAGGTACCTCTGAAAGC<br>GCAACCCCGGAATCTGGTCCAGGTAGCGAACCTGAAT<br>CTGGCTCTGAAACCCCAGGTACCTCTGAAAGCGCTA<br>CTCCTGAATCTGGCCCAGGTACTTCTACTGAACCGTCCG<br>AGGGCAGCGCACCAGGTACTTCTGAAAGCGCTACTCCT<br>GAGTCCGGCCCAGGTAGCCCGGCTGGCTCTCCGACTTC<br>CACCGAGGAAGGTAGCCCGGCTGGCTCTCCAACTTCTA | 710 | MEDIQMTQSPSSL<br>SASVGDRVTITCR<br>ASQDVNTAVAW<br>YQQKPGKAPKLL<br>IYSASFLYSGVPS<br>RFSGSRSGTDFTL<br>TISSLQPEDFATY<br>YCQQHYTTPPTF<br>GQGTKVEIKTGS<br>GEGSEGEGGGEG<br>SEGEGSGEGGEG<br>EGSGTEVQLVES<br>GGGLVQPGGSLR<br>LSCAASGFNIKDT<br>YIHWVRQAPGKG<br>LEWVARIYPTNG<br>YTRYADSVKGRF<br>TISADTSKNTAYL<br>QMNSLRAEDTAV<br>YYCSRWGGDGF<br>YAMDYWGQGTL<br>VTVSGSPGSPAGS<br>PTSTEEGTSESAT<br>PESGPGTSTEPSE<br>GSAPGSPAGSPTS<br>TEEGTSTEPSEGS<br>APGTSTEPSEGSA<br>PGTSESATPESGP<br>GSEPATSGSETPG<br>SEPATSGSETPGS<br>PAGSPTSTEEGTS<br>ESATPESGPGTST<br>EPSEGSAPGTSTE<br>PSEGSAPGSPAGS<br>PTSTEEGTSTEPS<br>EGSAPGTSTEPSE<br>GSAPGTSESATPE<br>SGPGTSTEPSEGS<br>APGTSESATPESG<br>PGSEPATSGSETP<br>GTSTEPSEGSAPG<br>TSTEPSEGSAPGT<br>SESATPESGPGTS<br>ESATPESGPGSPA<br>GSPTSTEEGTSES<br>ATPESGPGSEPAT<br>SGSETPGTSESAT<br>PESGPGTSTEPSE<br>GSAPGTSTEPSEG<br>SAPGTSTEPSEGS<br>APGTSTEPSEGSA<br>PGTSTEPSEGSAP<br>GTSTEPSEGSAPG<br>SPAGSPTSTEEGT<br>STEPSEGSAPGTS<br>ESATPESGPGSEP<br>ATSGSETPGTSES<br>ATPESGPGSEPAT<br>SGSETPGTSESAT<br>PESGPGTSTEPSE<br>GSAPGTSESATPE<br>SGPGSPAGSPTST<br>EEGSPAGSPTSTE | 735 |

TABLE 25-continued

DNA and amino acid sequences of binding fusion protein constructs

| Clone Name | DNA Sequence | SEQ ID NO: | Amino Acid Sequence | SEQ ID NO: |
|---|---|---|---|---|
| | CTGAAGAAGGTAGCCCGGCAGGCTCTCCGACCTCTACT<br>GAGGAAGGTACTTCTGAAAGCGCAACCCCGGAGTCCGG<br>CCCAGGTACCTCTACCGAACCGTCTGAGGGCAGCGCAC<br>CAGGTACCTCTGAAAGCGCAACTCCTGAGTCTGGCCCA<br>GGTAGCGAACCTGCTACCTCCGGCTCTGAGACTCCAGG<br>TACCTCTGAAAGCGCAACCCCGGAATCTGGTCCAGGTA<br>GCGAACCTGCAACCTCTGGCTCTGAAACCCCAGGTACC<br>TCTGAAAGCGCTACTCCTGAATCTGGCCCAGGTACTTCT<br>ACTGAACCGTCCGAGGGCAGCGCACCAGGTAGCCCTGC<br>TGGCTCTCCAACCTCCACCGAAGAAGGTACCTCTGAAA<br>GCGCAACCCCTGAATCCGGCCAGGTAGCGAACCGGCA<br>ACCTCCGGTTCTGAAACCCCAGGTACTTCTGAAAGCGC<br>TACTCCTGAGTCCGGCCCAGGTAGCCCGGCTGGCTCTC<br>CGACTTCCACCGAGGAAGGTAGCCCGGCTGGCTCTCCA<br>ACTTCTACTGAAGAAGGTACTTCTACCGAACCTTCCGA<br>GGGCAGCGCACCAGGTACTTCTGAAAGCGCTACCCCTG<br>AGTCCGGCCCAGGTACTTCTGAAAGCGCTACTCCTGAA<br>TCCGGTCCAGGTACTTCTGAAAGCGCTACCCCGGAATC<br>TGGCCCAGGTAGCGAACCGGCTACTTCTGGTTCTGAAA<br>CCCCAGGTAGCGAACCGGCTACCTCCGGTTCTGAAACT<br>CCAGGTAGCCAGCAGGCTCTCCGACTTCCACTGAGGA<br>AGGTACTTCTACTGAACCTTCCGAAGGCAGCGCACCAG<br>GTACCTCTACTGAACCTTCTGAGGGCAGCGCTCCAGGT<br>AGCGAACCTGCAACCTCTGGCTCTGAAACCCCAGGTAC<br>CTCTGAAAGCGCTACTCCTGAATCTGGCCCAGGTACTTC<br>TACTGAACCGTCCGAGGGCAGCGCACCA | | EGSPAGSPTSTEE<br>GTSESATPESGPG<br>TSTEPSEGSAPGT<br>SESATPESGPGSE<br>PATSGSETPGTSE<br>SATPESGPGSEPA<br>TSGSETPGTSESA<br>TPESGPGTSTEPS<br>EGSAPGSPAGSPT<br>STEEGTSESATPE<br>SGPGSEPATSGSE<br>TPGTSESATPESG<br>PGSPAGSPTSTEE<br>GSPAGSPTSTEEG<br>TSTEPSEGSAPGT<br>SESATPESGPGTS<br>ESATPESGPGTSE<br>SATPESGPGSEPA<br>TSGSETPGSPAGSP<br>TSTEEGTSTEPSE<br>GSAPGTSTEPSEG<br>SAPGSEPATSGSE<br>TPGTSESATPESG<br>PGTSTEPSEGSAP | |
| anti-Her2-AE576 | ATGGAAGACATTCAGATGACCCAGAGCCCGTCCTCCCT<br>GAGCGCTTCTGTTGGCGACCGCGTGACCATCACCTGCC<br>GTGCTTCCCAGGATGTTAACACCGCTGTAGCTTGGTATC<br>AACAGAAACCGGGCAAAGCACCGAAACTGCTGATCTA<br>CTCTGCTTCCTTTCTGTATAGCGGTGTTCCGTCTCGTTTC<br>AGCGGCTCTCGTAGCGGTACGGATTTTACTCTGACGAT<br>CAGCTCTCTGCAGCCGGAGGACTTCGCTACCTACTACT<br>GCCAGCAGCACTACACCACCCCGCCTACCTTTGGTCAG<br>GGCACCAAAGTGGAAATCAAGACCGGTTCTGGCGAAG<br>GCTCTGAAGGTGAAGGTGGTGGTGAAGGCTCTGAAGGT<br>GAAGGATCTGGTGAAGGTGGCGAAGGTGAGGGATCTG<br>GTACCGAGGTCCAGCTGGTTGAGTCTGGCGGCGGTCTG<br>GTCCAACCTGGTGGCTCCCTGCGCCTGTCTTGCGCAGCG<br>TCCGGCTTTAATATCAAAGATACGTACATTCACTGGGTC<br>CGCCAGGCACCGGGCAAAGGCCTGGAATGGGTTGCTCG<br>TATCTACCCGACTAACGGTTATACCCGTTATGCAGACA<br>GCGTAAAGGGTCGCTTCACGATCTCCGCGGATACCTCC<br>AAAAAACACCGCATACCTGCAAATGAACTCTCTGCGTGC<br>GGAAGATACTGCCGTGTACTACTGCTCTCGCTGGGGCG<br>GTGACGGTTTCTATGCAATGGACTACTGGGGTCAAGGT<br>ACTCTGGTAACTGTTTCCGGTCTCCAGGTAGCCCGGCT<br>GGCTCTCCTACCTCTACTGAGGAAGGTACTTCTGAAAG<br>CGCTACTCCTGAGTCTGGTCCAGGTACCTCTACTGAACC<br>GTCCGAAGGTAGCGCTCCAGGTAGCCCAGCAGGCTCTC<br>CGACTTCCACTGAGGAAGGTACTTCTACTGAACCTTCC<br>GAAGGCAGCGCACCAGGTACCTCTACTGAACCTTCTGA<br>GGGCAGCGCTCCAGGTACTTCTGAAAGCGCTACCCCGG<br>AATCTGGCCCAGGTAGCGAACCGGCTACTTCTGGTTCT<br>GAAACCCCAGGTAGCGAACCGGCTACCTCCGGTTCTGA<br>AACTCCAGGTAGCCCGGCAGGCTCTCCGACCTCTACTG<br>AGGAAGGTACTTCTGAAAGCGCAACCCCGGAGTCCGGC<br>CCAGGTACCTCTACCGAACCGTCTGAGGGCAGCGCACC<br>AGGTACTTCTACCGAACCGTCCGAGGGTAGCGCACCAG<br>GTAGCCCAGCAGGTTCTCCTACCTCCACCGAGGAAGGT<br>ACTTCTACCGAACCGTCCGAGGGTAGCGCACCAGGTAC<br>CTCTACTGAACCTTCTGAGGGCAGCGCTCCAGGTACTTC<br>TGAAAGCGCTACCCCGGAGTCCGGTCCAGGTACTTCTA<br>CTGAACCGTCCGAAGGTAGCGCACCAGGTACTTCTGAA<br>AGCGCAACCCCTGAATCCGGTCCAGGTAGCGAACCGGC<br>TACTTCTGGCTCTGAGACTCCAGGTACTTCTACCGAACC<br>GTCCGAAGGTAGCGCACCAGGTACTTCTACTGAACCGT<br>CTGAAGGTAGCGCACCAGGTACTTCTGAAAGCGCTACC<br>CCGGAATCCGGCCCAGGTACCTCTGAAAGCGCAACCCC<br>GGAGTCCGGCCCAGGTAGCCCTGCTGGCTCTCAACCT<br>CCACCGAAGAAGGTACCTCTGAAAGCGCAACCCCTGAA<br>TCCGGCCCAGGTAGCGAACCGGCAACCTCCGGTTCTGA<br>AACCCCAGGTACCTCTGAAAGCGCTACTCCGGAGTCTG | 711 | MEDIQMTQSPSSL<br>SASVGDRVTITCR<br>ASQDVNTAVAW<br>YQQKPGKAPKLL<br>IYSASFLYSGVPS<br>RFSGSRSGTDFTL<br>TISSLQPEDFATY<br>YCQQHYTTPPTF<br>GQGTKVEIKTGS<br>GEGSEGEGGGEG<br>SEGEGSGEGGEG<br>EGSGTEVQLVES<br>GGGLVQPGGSLR<br>LSCAASGFNIKDT<br>YIHWVRQAPGKG<br>LEWVARIYPTNG<br>YTRYADSVKGRF<br>TISADTSKNTAYL<br>QMNSLRAEDTAV<br>YYCSRWGGDGF<br>YAMDYWGQGTL<br>VTVSGSPGSPAGS<br>PTSTEEGTSESAT<br>PESGPGTSTEPSE<br>GSAPGSPAGSPTS<br>TEEGTSTEPSEGS<br>APGTSTEPSEGSA<br>PGTSESATPESGP<br>GSEPATSGSETPG<br>SEPATSGSETPGS<br>PAGSPTSTEEGTS<br>ESATPESGPGTST<br>EPSEGSAPGTSTE<br>PSEGSAPGSPAGS<br>PTSTEEGTSTEPS<br>EGSAPGTSTEPSE<br>GSAPGTSESATPE<br>SGPGTSTEPSEGS<br>APGTSESATPESG<br>PGSEPATSGSETP<br>GTSTEPSEGSAPG<br>TSTEPSEGSAPGT<br>SESATPESGPGTS<br>ESATPESGPGSPA<br>GSPTSTEEGTSES<br>ATPESGPGSEPAT<br>SGSETPGTSESAT | 736 |

TABLE 25-continued

DNA and amino acid sequences of binding fusion protein constructs

| Clone Name | DNA Sequence | SEQ ID NO: | Amino Acid Sequence | SEQ ID NO: |
|---|---|---|---|---|
| | GCCCAGGTACCTCTACTGAACCGTCTGAGGGTAGCGCT<br>CCAGGTACTTCTACTGAACCGTCCGAAGGTAGCGCACC<br>AGGTACTTCTACCGAACCGTCCGAAGGCAGCGCTCCAG<br>GTACCTCTACTGAACCTTCCGAGGGCAGCGCTCCAGGT<br>ACCTCTACCGAACCTTCTGAAGGTAGCGCACCAGGTAC<br>TTCTACCGAACCGTCCGAGGGTAGCGCACCAGGTAGCC<br>CAGCAGGTTCTCCTACCTCCACCGAGGAAGGTACTTCT<br>ACCGAACCGTCCGAGGGTAGCGCACCAGGTACCTCTGA<br>AAGCGCAACTCCTGAGTCTGGCCCAGGTAGCGAACCTG<br>CTACCTCCGGCTCTGAGACTCCAGGTACCTCTGAAAGC<br>GCAACCCCGGAATCTGGTCCAGGTAGCGAACCTGCAAC<br>CTCTGGCTCTGAAACCCCAGGTACCTCTGAAAGCGCTA<br>CTCCTGAATCTGGCCCAGGTACTTCTACTGAACCGTCCG<br>AGGGCAGCGCACCAGGTACTTCTGAAAGCGCTACTCCT<br>GAGTCCGGCCCAGGTAGCCCGGCTGGCTCTCCGACTTC<br>CACCGAGGAAGGTAGCCCGGCTGGCTCTCCAACTTCTA<br>CTGAAGAAGGTAGCCCGGCAGGCTCTCCGACCTCTACT<br>GAGGAAGGTACTTCTGAAAGCGCAACCCCGGAGTCCGG<br>CCCAGGTACCTCTACCGAACCGTCTGAGGGCAGCGCAC<br>CA | | PESGPGTSTEPSE<br>GSAPGTSTEPSEG<br>SAPGTSTEPSEGS<br>APGTSTEPSEGSA<br>PGTSTEPSEGSAP<br>GTSTEPSEGSAPG<br>SPAGSPTSTEEGT<br>STEPSEGSAPGTS<br>ESATPESGPGSEP<br>ATSGSETPGTSES<br>ATPESGPGSEPAT<br>SGSETPGTSESAT<br>PESGPGTSTEPSE<br>GSAPGTSESATPE<br>SGPGSPAGSPTST<br>EEGSPAGSPTSTE<br>EGSPAGSPTSTEE<br>GTSESATPESGPG<br>TSTEPSEGSAP | |
| anti-<br>Her2-<br>AE288 | ATGGAAGACATTCAGATGACCCAGAGCCCGTCCTCCCT<br>GAGCGCTTCTGTTGGCGACCGCGTGACCATCACCTGC<br>GTGCTTCCCAGGATGTTAACACCGCTGTAGCTTGGTATC<br>AACAGAAACCGGGCAAAGCACCGAAACTGCTGATCTA<br>CTCTGCTTCCTTTCTGTATAGCGGTGTTCCGTCTCGTTTC<br>AGCGGCTCTCGTAGCGGTACGGATTTTACTCTGACGAT<br>CAGCTCTCTGCAGCCGGAGGACTTCGCTACCTACTACT<br>GCCAGCAGCACTACACCACCCCGCCTACCTTTGGTCAG<br>GGCACCAAAGTGGAAATCAAGACCGGTTCTGGCGAAG<br>GCTCTGAAGGTGAAGGTGGTGGTGAAGGCTCTGAAGGT<br>GAAGGATCTGGTGAAGGTGGCGAAGGTGAGGGATCTG<br>GTACCGAGGTCCAGCTGGTTGAGTCTGGCGGCGGTCTG<br>GTCCAACCTGGTGGCTCCCTGCGCCTGTCTTGCGCAGCG<br>TCCGGCTTTAATATCAAAGATACGTACATTCACTGGGTC<br>CGCCAGGCACCGGGCAAAGGCCTGGAATGGGTTGCTCG<br>TATCTACCCGACTAACGGTTATACCCGTTATGCAGACA<br>GCGTAAAGGGTCGCTTCACGATCTCCGCGGATACCTCC<br>AAAAACACCGCATACCTGCAAATGAACTCTCTGCGTGC<br>GGAAGATACTGCCGTGTACTACTGCTCTCGCTGGGGCG<br>GTGACGGTTTCTATGCAATGGACTACTGGGGTCAAGGT<br>ACTCTGGTAACTGTTTCCGGGTCTCCAGGTACCTCTGAA<br>AGCGCAACTCCTGAGTCTGGCCCAGGTAGCGAACCTGC<br>TACCTCCGGCTCTGAGACTCCAGGTACCTCTGAAAGCG<br>CAACCCCGGAATCTGGTCCAGGTAGCGAACCTGCAACC<br>TCTGGCTCTGAAACCCCAGGTACCTCTGAAAGCGCTAC<br>TCCTGAATCTGGCCCAGGTACTTCTACTGAACCGTCCGA<br>GGGCAGCGCACCAGGTAGCCCTGCTGGCTCTCCAACCT<br>CCACCGAAGAAGGTACCTCTGAAAGCGCAACCCCTGAA<br>TCCGGCCCAGGTAGCGAACCGGCAACCTCCGGTTCTGA<br>AACCCCAGGTACTTCTGAAAGCGCTACTCCTGAGTCCG<br>GCCCAGGTAGCCCGGCTGGCTCTCCGACTTCCACCGAG<br>GAAGGTAGCCCGGCTGGCTCTCCAACTTCTACTGAAGA<br>AGGTACTTCTACCGAACCTTCCGAGGGCAGCGCACCAG<br>GTACTTCTGAAAGCGCTACCCCTGAGTCCGGCCCAGGT<br>ACTTCTGAAAGCGCTACTCCTGAATCCGGTCCAGGTAC<br>TTCTGAAAGCGCTACCCCGGAATCTGGCCCAGGTAGCG<br>AAACCGGCTACTTCTGGTTCTGAAACCCCAGGTAGCGAA<br>CCGGCTACCTCCGGTTCTGAAACTCCAGGTAGCCCAGC<br>AGGCTCTCCGACTTCCACTGAGGAAGGTACTTCTACTG<br>AACCTTCCGAAGGCAGCGCACCAGGTACCTCTACTGAA<br>CCTTCTGAGGGCAGCGCTCCAGGTAGCGAACCTGCAAC<br>CTCTGGCTCTGAAACCCCAGGTACCTCTGAAAGCGCTA<br>CTCCTGAATCTGGCCCAGGTACTTCTACTGAACCGTCCG<br>AGGGCAGCGCACCA | 712 | MEDIQMTQSPSSL<br>SASVGDRVTITCR<br>ASQDVNTAVAW<br>YQQKPGKAPKLL<br>IYSASFLYSGVPS<br>RFSGSRSGTDFTL<br>TISSLQPEDFATY<br>YCQQHYTTPPTF<br>GQGTKVEIKTGS<br>GEGSEGEGGGEG<br>SEGEGSGEGGEG<br>EGSGTEVQLVES<br>GGGLVQPGGSLR<br>LSCAASGFNIKDT<br>YIHWVRQAPGKG<br>LEWVARIYPTNG<br>YTRYADSVKGRF<br>TISADTSKNTAYL<br>QMNSLRAEDTAV<br>YYCSRWGGDGF<br>YAMDYWGQGTL<br>VTVSGSPGTSESA<br>TPESGPGSEPATS<br>GSETPGTSESATP<br>ESGPGSEPATSGS<br>ETPGTSESATPES<br>GPGTSTEPSEGSA<br>PGSPAGSPTSTEE<br>GTSESATPESGPG<br>SEPATSGSETPGT<br>SESATPESGPGSP<br>AGSPTSTEEGSPA<br>GSPTSTEEGTSTE<br>PSEGSAPGTSESA<br>TPESGPGTSESAT<br>PESGPGTSESATP<br>ESGPGSEPATSGS<br>ETPGSEPATSGSE<br>TPGSPAGSPTSTE<br>EGTSTEPSEGSAP<br>GTSTEPSEGSAPG<br>SEPATSGSETPGT<br>SESATPESGPGTS<br>TEPSEGSAP | 737 |
| AE912-<br>anti-Her2 | ATGGCTGAACCTGCTGGCTCTCCAACCTCCACTGAGGA<br>AGGTACCCCGGGTAGCGGTACTGCTTCTTCCTCTCCAGG<br>TAGCTCTACCCCTTCTGGTGCAACCGGCTCTCCAGGTGC<br>TTCTCCGGGCACCAGCTCTACCGGTTCTCCAGGTAGCCC<br>GGCTGGCTCTCCTACCTCTACTGAGGAAGGTACTTCTGA<br>AAGCGCTACTCCTGAGTCTGGTCCAGGTACCTCTACTG<br>AACCGTCCGAAGGTAGCGCTCCAGGTAGCCCAGCAGGC<br>TCTCCGACTTCCACTGAGGAAGGTACTTCTACTGAACCT | 713 | MAEPAGSPTSTEE<br>GTPGSGTASSSPG<br>SSTPSGATGSPGA<br>SPGTSSTGSPGSP<br>AGSPTSTEEGTSE<br>SATPESGPGTSTE<br>PSEGSAPGSPAGS<br>PTSTEEGTSTEPS | 738 |

TABLE 25-continued

DNA and amino acid sequences of binding fusion protein constructs

| Clone Name | DNA Sequence | SEQ ID NO: | Amino Acid Sequence | SEQ ID NO: |
|---|---|---|---|---|
| | TCCGAAGGCAGCGCACCAGGTACCTCTACTGAACCTTC | | EGSAPGTSTEPSE | |
| | TGAGGGCAGCGCTCCAGGTACTTCTGAAAGCGCTACCC | | GSAPGTSESATPE | |
| | CGGAATCTGGCCCAGGTAGCGAACCGGCTACTTCTGGT | | SGPGSEPATSGSE | |
| | TCTGAAACCCCAGGTAGCGAACCGGCTACCTCCGGTTC | | TPGSEPATSGSET | |
| | TGAAACTCCAGGTAGCCCGGCAGGCTCTCCGACCTCTA | | PGSPAGSPTSTEE | |
| | CTGAGGAAGGTACTTCTGAAAGCGCAACCCCGGAGTCC | | GTSESATPESGPG | |
| | GGCCCAGGTACCTCTACCGAACCGTCTGAGGGCAGCGC | | TSTEPSEGSAPGT | |
| | ACCAGGTACTTCTACCGAACCGTCCGAGGGTAGCGCAC | | STEPSEGSAPGSP | |
| | CAGGTAGCCCAGCAGGTTCTCCTACCTCCACCGAGGAA | | AGSPTSTEEGTST | |
| | GGTACTTCTACCGAACCGTCCGAGGGTAGCGCACCAGG | | EPSEGSAPGTSTE | |
| | TACCTCTACTGAACCTTCTGAGGGCAGCGCTCCAGGTA | | PSEGSAPGTSESA | |
| | CTTCTGAAAGCGCTACCCCGGAGTCCGGTCCAGGTACT | | TPESGPGTSTEPS | |
| | TCTACTGAACCGTCCGAAGGTAGCGCACCAGGTACTTC | | EGSAPGTSESATP | |
| | TGAAAGCGCAACCCCTGAATCCGGTCCAGGTAGCGAAC | | ESGPGSEPATSGS | |
| | CGGCTACTTCTGGCTCTGAGACTCCAGGTACTTCTACCG | | ETPGTSTEPSEGS | |
| | AACCGTCCGAAGGTAGCGCACCAGGTACTTCTACTGAA | | APGTSTEPSEGSA | |
| | CCGTCTGAAGGTAGCGCACCAGGTACTTCTGAAAGCGC | | PGTSESATPESGP | |
| | AACCCCGGAATCCGGCCCAGGTACCTCTGAAAGCGCAA | | GTSESATPESGPG | |
| | CCCCGGAGTCCGGCCCAGGTAGCCCTGCTGGCTCTCCA | | SPAGSPTSTEEGT | |
| | ACCTCCACCGAAGAAGGTACCTCTGAAAGCGCAACCCC | | SESATPESGPGSE | |
| | TGAATCCGGCCCAGGTAGCGAACCGGCAACCTCCGGTT | | PATSGSETPGTSE | |
| | CTGAAACCCCAGGTACCTCTGAAAGCGCTACTCCGGAG | | SATPESGPGTSTE | |
| | TCTGGCCCAGGTACCTCTACTGAACCGTCTGAGGGTAG | | PSEGSAPGTSTEP | |
| | CGCTCCAGGTACTTCTACTGAACCGTCCGAAGGTAGCG | | SEGSAPGTSTEPS | |
| | CACCAGGTACTTCTACCGAACCGTCCGAAGGCAGCGCT | | EGSAPGTSTEPSE | |
| | CCAGGTACCTCTACTGAACCTTCCGAGGGCAGCGCTCC | | GSAPGTSTEPSEG | |
| | AGGTACCTCTACCGAACCTTCTGAAGGTAGCGCACCAG | | SAPGTSTEPSEGS | |
| | GTACTTCTACCGAACCGTCCGAGGGTAGCGCACCAGGT | | APGSPAGSPTSTE | |
| | AGCCCAGCAGGTTCTCCTACCTCCACCGAGGAAGGTAC | | EGTSTEPSEGSAP | |
| | TTCTACCGAACCGTCCGAGGGTAGCGCACCAGGTACCT | | GTSESATPESGPG | |
| | CTGAAAGCGCAACTCCTGAGTCTGGCCCAGGTAGCGAA | | SEPATSGSETPGT | |
| | CCTGCTACCTCCGGCTCTGAGACTCCAGGTACCTCTGAA | | SESATPESGPGSE | |
| | AGCGCAACCCCGGAATCTGGTCAGGTAGCGAACCTGC | | PATSGSETPGTSE | |
| | AACCTCTGGCTCTGAAACCCCAGGTACCTCTGAAAGCG | | SATPESGPGTSTE | |
| | CTACTCCTGAATCTGGCCCAGGTACTTCTACTGAACCGT | | PSEGSAPGTSESA | |
| | CCGAGGGCAGCGCACCAGGTACTTCTGAAAGCGCTACT | | TPESGPGSPAGSP | |
| | CCTGAGTCCGGCCCAGGTAGCCCGGCTGGCTCTCCGAC | | TSTEEGSPAGSPT | |
| | TTCCACCGAGGAAGGTAGCCCGGCTGGCTCTCAACTT | | STEEGSPAGSPTS | |
| | CTACTGAAGAAGGTAGCCCGGCAGGCTCTCCGACCTCT | | TEEGTSESATPES | |
| | ACTGAGGAAGGTACTTCTGAAAGCGCAACCCCGGAGTC | | GPGTSTEPSEGSA | |
| | CGGCCCAGGTACCTCTACCGAACCGTCTGAGGGCAGCG | | PGTSESATPESGP | |
| | CACCAGGTACCTCTGAAAGCGCAACTCCTGAGTCTGGC | | GSEPATSGSETPG | |
| | CCAGGTAGCGAACCTGCTACCTCCGGCTCTGAGACTCC | | TSESATPESGPGS | |
| | AGGTACCTCTGAAAGCGCAACCCCGGAATCTGGTCCAG | | EPATSGSETPGTS | |
| | GTAGCGAACCTGCAACCTCTGGCTCTGAAACCCCAGGT | | ESATPESGPGTST | |
| | ACCTCTGAAAGCGCTACTCCTGAATCTGGCCCAGGTAC | | EPSEGSAPGSPAG | |
| | TTCTACTGAACCGTCCGAGGGCAGCGCACCAGGTAGCC | | SPTSTEEGTSESA | |
| | CTGCTGGCTCTCAACCTCCACCGAAGAAGGTACCTCT | | TPESGPGSEPATS | |
| | GAAAGCGCAACCCCTGAATCCGGCCCAGGTAGCGAACC | | GSETPGTSESATP | |
| | GGCAACCTCCGGTTCTGAAACCCCAGGTACTTCTGAAA | | ESGPGSPAGSPTS | |
| | GCGCTACTCCTGAGTCCGGCCCAGGTAGCCCGGCTGGC | | TEEGSPAGSPTST | |
| | TCTCCGACTTCCACCGAGGAAGGTAGCCCGGCTGGCTC | | EEGTSTEPSEGSA | |
| | TCCAACTTCTACTGAAGAAGGTACTTCTACCGAACCTTC | | PGTSESATPESGP | |
| | CGAGGGCAGCGCACCAGGTACTTCTGAAAGCGCTACCC | | GTSESATPESGPG | |
| | CTGAGTCCGGCCCAGGTACTTCTGAAAGCGCTACTCCT | | TSESATPESGPGS | |
| | GAATCCGGTCCAGGTACTTCTGAAAGCGCTACCCCGGA | | EPATSGSETPGSE | |
| | ATCTGGCCCAGGTAGCGAACCGGCTACTTCTGGTTCTG | | PATSGSETPGSPA | |
| | AAACCCCAGGTAGCGAACCGGCTACCTCCGGTTCTGAA | | GSPTSTEEGTSTE | |
| | ACTCCAGGTAGCCCAGCAGGCTCTCCGACTTCCACTGA | | PSEGSAPGTSTEP | |
| | GGAAGGTACTTCTACTGAACCTTCCGAAGGCAGCGCAC | | SEGSAPGSEPATS | |
| | CAGGTACCTCTACTGAACCTTCTGAGGGCAGCGCTCCA | | GSETPGTSESATP | |
| | GGTAGCGAACCTGCAACCTCTGGCTCTGAAACCCCAGG | | ESGPGTSTEPSEG | |
| | TACCTCTGAAAGCGCTACTCCTGAATCTGGCCCAGGTA | | SAPGSSSLDIQMT | |
| | CTTCTACTGAACCGTCCGAGGGCAGCGCACCAGGTTCG | | QSPSSLSASVGDR | |
| | TCTTCACTCGACATTCAGATGACCCAGAGCCCGTCGTCC | | VTITCRASQDVN | |
| | CTGAGCGCTTCTGTTGGCGACCGCGTGACCATCACCTG | | TAVAWYQQKPG | |
| | CCGTGCTTCCCAGGATGTTAACACCGCTGTAGCTTGGTA | | KAPKLLIYSASFL | |
| | TCAACAGAAACCGGGCAAAGCACCGAAACTGCTGATCT | | YSGVPSRFSGSRS | |
| | ACTCTGCTTCCTTTCTGTATAGCGGTGTTCCGTCTCGTTT | | GTDFTLTISSLQP | |
| | CAGCGGCTCTCGTAGCGGTACGGATTTTACTCTGACGA | | EDFATYYCQQHY | |
| | TCAGCTCTCTGCAGCCGGAGGACTTCGCTACCTACTACT | | TTPPTFGQGTKVE | |
| | GCCAGCAGCACTACACCACCCCGCCTACCTTTGGTCAG | | IKTGSGEGSEGEG | |
| | GGCACCAAAGTGGAAATCAAGACCGGTTCTGGCGAAG | | GGEGSEGEGSGE | |
| | GCTCTGAAGGTGAAGGTGGTGGTGAAGGCTCTGAAGGT | | GGEGEGSGTEVQ | |

TABLE 25-continued

DNA and amino acid sequences of binding fusion protein constructs

| Clone Name | DNA Sequence | SEQ ID NO: | Amino Acid Sequence | SEQ ID NO: |
|---|---|---|---|---|
| | GAAGGATCTGGTGAAGGTGGCGAAGGTGAGGGATCTG<br>GTACCGAGGTCCAGCTGGTTGAGTCTGGCGGCGGTCTG<br>GTCCAACCTGGTGGCTCCCTGCGCCTGTCTTGCGCAGCG<br>TCCGGCTTTAATATCAAAGATACGTACATTCACTGGGTC<br>CGCCAGGCACCGGGCAAAGGCCTGGAATGGGTTGCTCG<br>TATCTACCCGACTAACGGTTATACCCGTTATGCAGACA<br>GCGTAAAGGGTCGCTTCACGATCTCCGCGGATACCTCC<br>AAAAACACCGCATACCTGCAAATGAACTCTCTGCGTGC<br>GGAAGATACTGCCGTGTACTACTGCTCTCGCTGGGGCG<br>GTGACGGTTTCTATGCAATGGACTACTGGGGTCAAGGT<br>ACTCTGGTAACTGTTTCC | | LVESGGGLVQPG<br>GSLRLSCAASGF<br>NIKDTYIHWVRQ<br>APGKGLEWVARI<br>YPTNGYTRYADS<br>VKGRFTISADTSK<br>NTAYLQMNSLRA<br>EDTAVYYCSRW<br>GGDGFYAMDYW<br>GQGTLVTVS | |
| anti-<br>EGFR-<br>Y576-<br>FLAG-<br>HIS6<br>("His6"<br>disclosed<br>as SEQ ID<br>NO: 218) | ATGGAGGATATTCTGCTGACGCAAAGCCCTGTTATTCT<br>GTCTGTTAGCCCGGGTGAGCGCGTTAGCTTCAGCTGCC<br>GTGCATCTCAGAGCATTGGCACGAACATTCATTGGTAT<br>CAACAACGTACCAACGGTAGCCCGCGTCTGCTGATTAA<br>ATACGCATCCGAATCTATCTCTGGTATCCCGTCTCGCTT<br>CAGCGGTTCTGGTAGCGGCACCGACTTTACCCTGAGCA<br>TTAACTCTGTAGAAAGCGAAGATATTGCGGATTACTAC<br>TGCCAGCAGAACAACAACTGGCCGACTACTTTTGGTGC<br>AGGTACTAAACTGGAACTGAAAACCGGTTCTGGCGAAG<br>GCTCTGAAGGTGAAGGTGGTGGTGAAGGCTCTGAAGGT<br>GAAGGATCTGGTGAAGGTGGCGAAGGTGAGGGATCTG<br>GTACCCAAGTGCAGCTGAAACAGAGCGGTCCGGGTCTG<br>GTGCAACCATCCCAGTCTCTGTCTATTACCTGTACCGTT<br>AGCGGTTTCTCCCTGACCAACTACGGTGTTCACTGGGTT<br>CGCCAGTCCCCAGGCAAAGGCCTGGAATGGCTGGGCGT<br>TATTTGGTCCGGCGGCAATACGGATTATAACACCCCGT<br>TCACCTCTCGTCTGTCTATCAACAAAGATAATTCTAAAA<br>GCCAGGTATTCTTCAAGATGAACTCTCTGCAGAGCAAT<br>GACACCGCCATCTACTATTGCGCTCGTGCCCTGACTTAC<br>TACGATTACGAGTTCGCATATTGGGGCCAGGGCACTCT<br>GGTGACCGTTTCCGGAGGTGAGGGTTCTGGCGAAGGTT<br>CCGAAGGTGAGGGCTCCGAAGGATCTGGCGAAGGTGA<br>GGGTTCCGAAGGTTCTGGCGAAGGTGAAGGCGGTTCTG<br>AGGGATCCGAAGGTGAAGGTCCGAAGGATCTGGCGA<br>AGGTGAAGGTGGTGAAGGTTCTGGCGAAGGTGAGGGA<br>TCTGGCGAAGGCTCTGAAGGTGAAGGTGGTGGTGAAGG<br>CTCTGAAGGTGAAGGATCTGGTGAAGGTGGCGAAGGTG<br>AGGGATCTGAAGGCGGCTCCGAAGGTGAAGGCGGATC<br>TGAAGGCGGCGAAGGTGAAGGTTCCGAAGGTTCTGGTG<br>AAGGTGAAGGATCTGAAGGTGGCTCCGAAGGTGAAGG<br>ATCTGAAGGCGGTTCCGAAGGTGAGGGCTCTGAAGGTT<br>CTGGCGAAGGTGAAGGCTCTGAAGGATCTGGTGAAGGT<br>GAAGGTTCCGAAGGTTCTGGTGAAGGTGAAGGTTCCGA<br>AGGTTCTGGCGAAGGTGAAGGTTCTGAAGGTGGCTCTG<br>AAGGTGAAGGCGGCTCTGAAGGATCCGAAGGTGAAGG<br>TTCTGGTGAAGGCTCTGAAGGTGAAGGCGGCTCTGAGG<br>GTTCCGAAGGTGAAGGCGGAGGCGAAGGTTCTGAAGG<br>TGAGGGATCTGGTGAAGGTTCTGAAGGTGAAGGCGGTT<br>CTGAAGGTTCCGAAGGTGAAGGTGGCTCTGAGGGATCC<br>GAAGGTGAAGGTGGCGAAGGATCTGGTGAAGGTGAAG<br>GTTCTGAAGGTTCTGGCGAAGGTGAGGGTTCTGGCGAA<br>GGTTCCGAAGGTGAGGGCTCCGAAGGATCTGGCGAAG<br>GTGAGGGTTCCGAAGGTTCTGGCGAAGGTGAAGGCGGT<br>TCTGAGGGATCCGAAGGTGAGGGTTCTGGCGAAGGTTC<br>CGAAGGTGAGGGCTCCGAAGGATCTGGCGAAGGTGAG<br>GGTTCCGAAGGTTCTGGCGAAGGTGAAGGCGGTTCTGA<br>GGGATCCGAAGGTGAAGGCGGTTCTGAAGGTTCCGAAG<br>GTGAAGGTGGCTCTGAGGGATCCGAAGGTGAAGGTGG<br>CGAAGGATCTGGTGAAGGTGAAGGTTCTGAAGGTTCTG<br>GCGAAGGTGAGGGTTCTGGCGAAGGTTCCGAAGGTGA<br>GGGCTCCGAAGGATCTGGCGAAGGTGAGGGTTCCGAA<br>GGTTCGGCGAAGGTGAAGGCGGTTCTGAGGGATCCGA<br>AGGTGAAGGCTCCGAAGGATCTGGCGAAGGTGAAGGT<br>GGTGAAGGTTCTGGCGAAGGTGAGGGATCTGGCGAAG<br>GCTCTGAAGGTGAAGGTGGTGGTGAAGGCTCTGAAGGT<br>GAAGGTTCCGAAGGTTCTGGTGAAGGTGAAGGTTCCGA<br>AGGTTCTGGCGAAGGTGAAGGTTCTGAAGGTGGCTCTG<br>AAGGTGAAGGCGGCTCTGAAGGATCCGAAGGTGAAGG<br>ATCTGAAGGTGGCTCCGAAGGTGAAGGATCTGAAGGCG<br>GTTCCGAAGGTGAGGGCTCTGAAGGTTCTGGCGAAGGT<br>GAAGGCTCTGAAGGATCTGGTGAAGGTGAAGGATCTGG<br>CGAAGGCTCCGAAGGTGAAGGCGGTTCTGAAGGTGGC | 714 | MEDILLTQSPVIL<br>SVSPGERVSFSCR<br>ASQSIGTNIHWY<br>QQRTNGSPRLLIK<br>YASESISGIPSRFS<br>GSGSGTDFTLSIN<br>SVESEDIADYYC<br>QQNNNWPTTFGA<br>GTKLELKTGSGE<br>GSEGEGGGEGSE<br>GEGSGEGGEGEG<br>SGTQVQLKQSGP<br>GLVQPSQSLSITC<br>TVSGFSLTNYGV<br>HWVRQSPGKGLE<br>WLGVIWSGGNTD<br>YNTPFTSRLSINK<br>DNSKSQVFFKMN<br>SLQSNDTAIYYC<br>ARALTYYDYEFA<br>YWGQGTLVTVS<br>GGEGSGEGSEGE<br>GSEGSGEGEGSE<br>GSGEGEGGSEGS<br>EGEGSEGSGEGE<br>GGEGSGEGEGSG<br>EGSEGEGGGEGS<br>EGEGSGEGGEGG<br>GSEGGSEGEGGS<br>EGGEGEGSEGSG<br>EGEGSEGGSEGE<br>GSEGGSEGEGSE<br>GSEGEGSEGSG<br>EGEGSEGSGEGE<br>GSEGSGEGEGSE<br>GGSEGEGSEGSG<br>EGSEGEGGSEGE<br>GGSEGSEGEGGG<br>EGSEGEGSGEGSE<br>GEGGSEGSEGEG<br>GSEGSGEGEGGG<br>SGEGEGSEGSGE<br>GEGSGEGSEGEG<br>SEGSGEGEGSEGS<br>GEGGSEGSEGEG<br>EGSGEGSEGEGSE<br>GSGEGEGSEGSG<br>EGEGGSEGSEGE<br>GGSEGSEGEGSG<br>EGSEGEGGEGSG<br>EGEGSEGSGEGE<br>GSGEGSEGEGSE<br>GSGEGEGSEGSG<br>EGEGGSEGSEGE<br>GSEGEGSEGGGE<br>GSGEGSEGEGSE<br>GSGEGEGSEGSG<br>EGEGGSEGSEGE<br>GGSEGSEGEGSG<br>EGSEGEGGEGSG<br>EGEGSEGSGEGE<br>GSGEGSEGEGSE<br>GSGEGEGSEGGS<br>EGEGGSEGSEGE<br>GSEGEGSEGSGE<br>GEGSGEGSEGEG<br>SEGSGEGEGSEGS<br>GEGGSEGSEGSG | 739 |

TABLE 25-continued

DNA and amino acid sequences of binding fusion protein constructs

| Clone Name | DNA Sequence | SEQ ID NO: | Amino Acid Sequence | SEQ ID NO: |
|---|---|---|---|---|
| | GAAGGTGAAGGATCTGAAGGTGGTTCCGAAGGTGAGG<br>GATCTGAAGGTGGCTCTGAAGGTGAAGGTGGCGAAGGT<br>TCTGGCGAAGGTGAAGGTGGAGGCGAAGGTTCTGAAG<br>GTGAAGGTTCCGAAGGTTCTGGTGAAGGTGAGGGATCT<br>GGCGAAGGTTCTGAAGGTGATTATAAAGACGATGACGA<br>TAAAGGTGGTTCTCATCACCATCACCATCACTAA | | EGEGSEGSGEGE<br>GSGEGSEGEGGS<br>EGGEGEGSEGGS<br>EGEGSEGGSEGE<br>GGEGSGEGEGGG<br>EGSEGEGSEGSGE<br>GEGSGEGSEGDY<br>KDDDDKGGSHH<br>HHHH | |
| anti-CD3-<br>Y288-<br>GFP-<br>HIS8 ("His8"<br>disclosed<br>as SEQ ID<br>NO: 697) | ATGAAAGACATCCAGATGACCCAGTCTCCTTCCTCTCTG<br>TCCGCGTCCGTGGGCGACCGTGTTACTATCACCTGCTCC<br>GCCTCCTCTTCTGTCAGCTACATGAACTGGTATCAGCAG<br>ACTCCTGGCAAAGCTCCAAAACGTTGGATTTACGATAC<br>GTCCAAGCTGGCCTCCGGCGTACCAAGCCGTTTCTCTG<br>GCTCTGGCAGCGGCACGGATTACACCTTCACTATTCTA<br>GCCTGCAGCCTGAAGATATTGCCACCTATTACTGCCAA<br>CAATGGTCCTCCAATCCTTTTACCTTTGGTCAGGGCACT<br>AAGCTGCAGATTACTCGCACCGGTTCTGGCGAAGGCTC<br>TGAAGGTGAAGGTGGTGGTGAAGGCTCTGAAGGTGAA<br>GGATCTGGTGAAGGTGGCGAAGGTGAGGGATCTGGTAC<br>CCAGGTCCAACTGGTTCAATCCGGCGGCGGTGTAGTTC<br>AACCGGGTCGCTCTCTGCGTCTTTCCTGCAAGGCGTCCG<br>GTTACACTTTCACGCGTTACACCATGCACTGGGTCCGTC<br>AGGCTCCTGGTAAAGGTCTGGAATGGATTGGCTATATC<br>AACCCGTCTCGCGGCTATACCAACTATAACCAGAAATT<br>CAAAGATCGTTTTACGATTTCCACTGATAAATCCAAAA<br>GCACCGCATTCCTCCAAATGGACAGCCTGCGTCCGGAA<br>GACACGGCGGTTTATTATTCCGCCCGTTACTACGATGAC<br>CACTACTGCCTGGATTATTGGGGCCAAGGCACTCCAGT<br>AACCGTGAGCAGCGGAGGTGAGGGTTCTGGCGAAGGTT<br>CCGAAGGTGAGGGCTCCGAAGGATCTGGCGAAGGTGA<br>GGGTTCCGAAGGTTCTGGCGAAGGTGAAGGCGGTTCTG<br>AGGGATCCGAAGGTGAAGGCGGTTCTGAGGGATCTGA<br>AGGTGAAGGTGGCTCTGAAGGATCTGAAGGTGAGGGA<br>TCTGGTGAAGGTTCTGAAGGTGAAGGCGGCTCTGAGGG<br>TTCTGAAGGTGAAGGATCTGGTGAAGGTTCCGAAGGTG<br>AGGGTTCTGAAGGTGGTTCTGAAGGTGAAGGCGGTTCT<br>GAGGGTTCTGAAGGTGAGGGTTCTGGCGAAGGTTCCGA<br>AGGTGAAGGCGGCGAAGGTGGATCTGAAGGTGAGGGC<br>TCCGAAGGATCTGGCGAAGGTGAAGGTTCTGGCGAAGG<br>TTCCGAAGGTGAAGGTTCTGAAGGATCTGGCGAAGGTG<br>AGGGTTCTGGCGAAGGTTCCGAAGGTGAGGGCTCCGAA<br>GGATCTGGCGAAGGTGAGGGTTCCGAAGGTTCTGGCGA<br>AGGTGAAGGCGGTTCTGAGGGATCCGAAGGTGAAGGC<br>TCCGAAGGATCTGGCGAAGGTGAAGGTGGTGAAGGTTC<br>TGGCGAAGGTGAGGGATCTGGCGAAGGCTCTGAAGGT<br>GAAGGTGGTGGTGAAGGCTCTGAAGGTGAAGGATCTG<br>GTGAAGGTGGCGAAGGTGAGGGATCTGAAGGCGGCTC<br>CGAAGGTGAAGGCGGATCTGAAGGCGGCGAAGGTGAA<br>GGTTCCGAAGGTTCTGGTGAAGGTGAAGGATCTGAAGG<br>TGGCTCCGAAGGTGAAGGATCTGAAGGCGGTTCCGAAG<br>GTGAGGGCTCTGAAGGTTCTGGCGAAGGTGAAGGCTCT<br>GAAGGATCTGGTGAAGGTCGTCTTCACTCGAGGGTAC<br>CGAACTTTTCACTGGAGTTGTCCCAATTCTTGTTGAATT<br>AGATGGTGATGTTAATGGGCACAAATTTTCTGTCAGTG<br>GAGAGGGTGAAGGTGATGCAACATACGGAAAACTTAC<br>CCTTAAATTTATTTGCACTACTGGAAAACTACCTGTTCC<br>ATGGCCAACACTTGTCACTACTTTCTCTTATGGTGTTCA<br>ATGCTTTTCCCGTTATCCGGATCACATGAAACGGCATG<br>ACTTTTTCAAGAGTGCCATGCCCGAAGGTTATGTACAG<br>GAACGCACTATATCTTTCAAAGATGACGGGAACTACAA<br>GACGCGTGCTGAAGTCAAGTTTGAAGGTGATACCCTTG<br>TTAATCGTATCGAGTTAAAAGGTATTGATTTTAAAGAA<br>GATGGAAACATTCTCGGACACAAACTCGAGTACTA<br>TAACTCACACAATGTATACATCACGGCAGACAAACAAA<br>AGAATGGAATCAAAGCTAACTTCAAAATTCGCCACAAC<br>ATTGAAGATGGATCCGTTCAACTAGCAGACCATTATCA<br>ACAAAATACTCCAATTGGCGATGGCCCTGTCCTTTTACC<br>AGACAACCATTACCTGTCGACACAATCTGCCCTTTCGA<br>AGATCCCAACGAAAAGCGTGACCACATGGTCCTTCTT | 715 | MKDIQMTQSPSS<br>LSASVGDRVTITC<br>SASSSVSYMNWY<br>QQTPGKAPKRWI<br>YDTSKLASGVPS<br>RFSGSGSGTDYTF<br>TISSLQPEDIATY<br>YCQQWSSNPFTF<br>GQGTKLQITRTGS<br>GEGSEGEGGGEG<br>SEGEGSGEGGEG<br>EGSGTQVQLVQS<br>GGGVVQPGRSLR<br>LSCKASGYTFTR<br>YTMHWVRQAPG<br>KGLEWIGYINPSR<br>GYTNYNQKFKDR<br>FTISTDKSKSTAF<br>LQMDSLRPEDTA<br>VYYSARYYDDH<br>YCLDYWGQGTP<br>VTVSSGGEGSGE<br>GSEGEGSEGSGE<br>GEGSSEGSGEGG<br>GSEGSEGEGGSE<br>GSEGEGGSEGSE<br>GEGSGEGSEGEG<br>GSEGSEGEGSGE<br>GSEGSEGGSEGG<br>GEGGSEGSEGEG<br>SGEGSGEGGGEG<br>GSEGEGSEGSGE<br>GEGSGEGSEGEG<br>SEGSGEGSEGGS<br>GSEGEGSGEGSE<br>GEGSEGSGEGEG<br>GSEGSEGEGSEGS<br>GEGEGGEGSGEG<br>EGSGEGSEGEGG<br>GEGSGEGSSEGG<br>GEGEGSEGGSEG<br>EGGSEGGEGEGS<br>EGSGEGSEGSEGG<br>SEGEGSEGGSEGE<br>GSEGSEGEGSE<br>GSGEGSSSLEGTE<br>LFTGVVPILVELD<br>GDVNGHKFSVSG<br>EGEGDATYGKLT<br>LKFICTTGKLPVP<br>WPTLVTTFSYGV<br>QCFSRYPDHMKR<br>HDFFKSAMPEGY<br>VQERTISFKDDG<br>NYKTRAEVKFEG<br>DTLVNRIELKGID<br>FKEDGNILGHKL<br>EYNYNSHNVYIT<br>ADKQKNGIKANF<br>KIRHNIEDGSVQL<br>ADHYQQNTPIGD | 740 |

TABLE 25-continued

DNA and amino acid sequences of binding fusion protein constructs

| Clone Name | DNA Sequence | SEQ ID NO: | Amino Acid Sequence | SEQ ID NO: |
|---|---|---|---|---|
| | GAGTTTGTAACTGCTGCTGGGATTGGTGGCTCTCATCAC CATCACCATCACCATCACTAA | | GPVLLPDNHYLS TQSALSKDPNEK RDHMVLLEFVTA AGIGGSHHHHHH HH | |
| anti-Her2-Y288-anti-CD3-HA-His6, AC48 ("His6" disclosed as SEQ ID NO: 218) | ATGGAGGACATTCAGATGACCCAGAGCCCGTCCTCCCT GAGCGCTTCTGTTGGCGACCGCGTGACCATCACCTGCC GTGCTTCCCAGGATGTTAACACCGCTGTAGCTTGGTATC AACAGAAACCGGGCAAAGCACCGAAACTGCTGATCTA CTCTGCTTCCTTTCTGTATAGCGGTGTTCCGTCTCGTTTC AGCGGCTCTCGTAGCGGTACGGATTTTACTCTGACGAT CAGCTCTCTGCAGCCGGAGGACTTCGCTACCTACTACT GCCAGCAGCACTACACCACCCCGCCTACCTTTGGTCAG GGCACCAAAGTGGAAATCAAGACCGGTTCTGGCGAAG GCTCTGAAGGTGAAGGTGGTGGTGAAGGCTCTGAAGGT GAAGGATCTGGTGAAGGTGGCGAAGGTGAGGGATCTG GTACCGAGGTCCAGCTGGTTGAGTCTGGCGGCGGTCTG GTCCAACCTGGTGGCTCCCTGCGCCTGTCTTGCGCAGCG TCCGGCTTTAATATCAAAGATACGTACATTCACTGGGTC CGCCAGGCACCGGGCAAAGGCCTGGAATGGGTTGCTCG TATCTACCCGACTAACGGTTATACCCGTTATGCAGACA GCGTAAAGGGTCGCTTCACGATCTCCGCGGATACCTCC AAAAACACCGCATACCTGCAAATGAACTCTCTGCGTGC GGAAGATACTGCCGTGTACTACTGCTCTCGCTGGGGCG GTGACGGTTTCTATGCAATGGACTACTGGGGTCAAGGT ACTCTGGTAACTGTTTCCGGAGGTGAGGGTTCTGGCGA AGGTTCCGAAGGTGAGGGCTCCGAAGGATCTGGCGAA GGTGAGGGTTCCGAAGGTTCTGGCGAAGGTGAAGGCG GTTCTGAGGGATCCGAAGGTGAAGGCGGTTCTGAGGGA TCTGAAGGTGAAGGTGGCTCTGAAGGATCTGAAGGTGA GGGATCTGGTGAAGGTTCTGAAGGTGAAGGCGGCTCTG AGGGTTCTGAAGGTGAAGGATCTGGTGAAGGTTCCGAA GGTGAGGGTTCTGAAGGTGGTTCTGAAGGTGAAGGCGG TTCTGAGGGTTCTGAAGGTGAGGGTTCTGGCGAAGGTT CCGAAGGTGAAGGCGGCGAAGGTGGATCTGAAGGTGA GGGCTCCGAAGGATCTGGCGAAGGTGAAGGTTCTGGCG AAGGTTCCGAAGGTGAAGGTTCTGAAGGATCTGGCGAA GGTGAGGGTTCTGGCGAAGGTTCCGAAGGTGAGGGCTC CGAAGGATCTGGCGAAGGTGAGGGTTCCGAAGGTTCTG GCGAAGGTGAAGGCGGTTCTGAGGGATCCGAAGGTGAA AGGCTCCGAAGGATCTGGCGAAGGTGAAGGTGGTGAA GGTTCTGGCGAAGGTGAGGGATCTGGCGAAGGCTCTGA AGGTGAAGGTGGTGGTGAAGGCTCTGAAGGTGAAGGA TCTGGTGAAGGTGGCGAAGGTGAGGGATCTGAAGGCG GCTCCGAAGGTGAAGGCGGATCTGAAGGCGGCGAAGG TGAAGGTTCCGAAGGTTCTGGTGAAGGTGAAGGATCTG AAGGTGGCTCCGAAGGTGAAGGATCTGAAGGCGGTTCC GAAGGTGAGGGCTCTGAAGGTTCTGGCGAAGGTGAAG GCTCTGAAGGATCTGGTGAAGGTGACATCCAGATGACC CAGTCTCCTTCCTCTCTGTCCGCGTCCGTGGGCGACCGT GTTACTATCACCTGCTCCGCCTCCTCTTCTGTCAGCTAC ATGAACTGGTATCAGCAGACTCCTGGCAAAGCTCCAAA ACGTTGGATTTACGATACGTCCAAGCTGGCCTCCGGCG TACCAAGCCGTTTCTCTGGCTCTGGCAGCGGCACGGAT TACACCTTCACTATTTCTAGCCTGCAGCCTGAAGATATT GCCACCTATTACTGCCAACAATGGTCCTCCAATCCTTTT ACCTTTGGTCAGGGCACTAAGCTGCAGATTACTCGCAC CGGTTCTGGCGAAGGCTCTGAAGGTGAAGGTGGTGGTG AAGGCTCTGAAGGTGAAGGATCTGGTGAAGGTGGCGA AGGTGAGGGATCTGGTACCCAGGTCCAACTGGTTCAAT CCGGCGGCGGTGTAGTTCAACCGGGTCGCTCTCTGCGT CTTTCCTGCAAGGCGTCCGGTTACACTTTCACGCGTTAC ACCATGCACTGGGTCCGTCAGGCTCCTGGTAAAGGTCT GGAATGGATTGGCTATATCAACCCGTCTCGCGGCTATA CCAACTATAACCAGAAATTCAAAGATCGTTTTACGATT TCCACTGATAAATCCAAAAGCACCGCATTCCTCCAAAT GGACAGCCTGCGTCCGGAAGACACGGCCGTTTATTATT CCGCCCCGTTACTACGATGACCACTACTGCCTGGATTATT | 716 | MEDIQMTQSPSSL SASVGDRVTITCR ASQDVNTAVAW YQQKPGKAPKLL IYSASFLYSGVPS RFSGSRSGTDFTL TISSLQPEDFATY YCQQHYTTPPTF GQGTKVEIKTGS GEGSEGEGGGEG SEGEGSGEGGEG EGSGTEVQLVES GGGLVQPGGSLR LSCAASGFNIKDT YIHWVRQAPGKG LEWVARIYPTNG YTRYADSVKGRF TISADTSKNTAYL QMNSLRAEDTAV YYCSRWGGDGF YAMDYWGQGTL VTVSGGEGSGEG SEGEGSEGSGEGE GSEGSGEGEGGS EGSEGEGGSEGSE GEGGSEGSEGEG SGEGSEGEGGSE GEGSEGEGGSEGSE GSEGSEGEGGSE GEGSEGSGEGEG SGEGSEGEGSEGS GEGEGSGEGSEG EGSEGSGEGEGSE GSEGEGGSEGS EGEGSEGSGEGE GGEGSGEGEGSG EGSEGEGGGEGS EGEGSGEGGEG EGEGSGEGGEGE GSEGGSEGEGGS EGGEGEGSEGSG EGEGSEGGSEGE GSEGGSEGEGSE GSGEGEGSEGSG SGEGEGSEGSSG EGDIQMTQSPSSL SASVGDRVTITCS ASSSVSYMNWY QQTPGKAPKRWI YDTSKLASGVPS RFSGSGSGTDYTF TISSLQPEDIATY YCQQWSSNPFTF GQGTKLQITRTGS GEGSEGEGGGEG SEGEGSGEGGEG EGSGTQVQLVQS GGGVVQPGRSLR LSCKASGYTFTR YTMHWVRQAPG KGLEWIGYINPSR GYTNYNQKFKDR FTISTDKSKSTAF | 741 |

TABLE 25-continued

DNA and amino acid sequences of binding fusion protein constructs

| Clone Name | DNA Sequence | SEQ ID NO: | Amino Acid Sequence | SEQ ID NO: |
|---|---|---|---|---|
| | GGGGCCAAGGCACTCCAGTAACCGTGAGCAGCGGCGG TTATCCTTATGATGTTCCAGACTATGCAGGTGGCTCTCA TCACCATCACCATCACTGA | | LQMDSLRPEDTA VYYSARYYDDH YCLDYWGQGTP VTVSSGGYPYDV PDYAGGSHHHHH H | |
| anti-Her2-Y288-anti-EGFR-HA-His6, AC49 ("His6" disclosed as SEQ ID NO: 218) | ATGGAGGACATTCAGATGACCCAGAGCCCGTCCTCCCT GAGCGCTTCTGTTGGCGACCGCGTGACCATCACCTGCC GTGCTTCCCAGGATGTTAACACCGCTGTAGCTTGGTATC AACAGAAACCGGGCAAAGCACCGAAACTGCTGATCTA CTCTGCTTCCTTTCTGTATAGCGGTGTTCCGTCTCGTTTC AGCGGCTCTCGTAGCGGTACGGATTTTACTCTGACGAT CAGCTCTCTGCAGCCGGAGGACTTCGCTACCTACTACT GCCAGCAGCACTACACCCCGCCTACCTTTGGTCAG GGCACCAAAGTGGAAATCAAGACCGGTTCTGGCGAAG GCTCTGAAGGTGAAGGTGGTGGTGAAGGCTCTGAAGGT GAAGGATCTGGTGAAGGTGGCGAAGGTGAGGGATCTG GTACCGAGGTCCAGCTGGTTGAGTCTGGCGGCGGTCTG GTCCAACCTGGTGGCTCCCTGCGCCTGTCTTGCGCAGCG TCCGGCTTTAATATCAAAGATACGTACATTCACTGGGTC CGCCAGGCACCGGGCAAAGGCCTGGAATGGGTTGCTCG TATCTACCCGACTAACGGTTATACCCGTTATGCAGACA GCGTAAAGGTCGCTTCACGATCTCCGCGGATACCTCC AAAAACACCGCATACCTGCAAATGAACTCTCTGCGTGC GGAAGATACTGCCGTGTACTACTGCTCTCGCTGGGGCG GTGACGGTTTCTATGCAATGGACTACTGGGGTCAAGGT ACTCTGGTAACTGTTTCCGGAGGTGAGGGTTCTGGCGA AGGTTCCGAAGGTGAGGGCTCCGAAGGATCTGGCGAA GGTGAGGGTTCCGAAGGTTCTGGCGAAGGTGAAGGCG GTTCTGAGGGATCCGAAGGTGAAGGCGGTTCTGAGGGA TCTGAAGGTGAAGGTGGCTCTGAAGGATCTGAAGGTGA GGGATCTGGTGAAGGTTCTGAAGGTGAAGGCGGCTCTG AGGGTTCTGAAGGTGAAGGATCTGGTGAAGGTTCCGAA GGTGAGGGTTCTGAAGGTGGTTCTGAAGGTGAAGGCGG TTCTGAGGGTTCTGAAGGTGAGGGTTCTGGCGAAGGTT CCGAAGGTGAAGGCGGCGAAGGTGGATCTGAAGGTGA GGGCTCCGAAGGATCTGGCGAAGGTGAAGGTTCTGGCG AAGGTTCCGAAGGTGAAGGTTCTGAAGGATCTGGCGAA GGTGAGGGTTCTGGCGAAGGTTCCGAAGGTGAGGGCTC CGAAGGATCTGGCGAAGGTGAGGGTTCCGAAGGTTCTG GCGAAGGTGAAGGCGGTTCTGAGGGATCCGAAGGTGA AGGCTCCGAAGGATCTGGCGAAGGTGAAGGTGGTGAA GGTTCTGGCGAAGGTGAGGGATCTGGCGAAGGCTCTGA AGGTGAAGGTGGTGGTGAAGGCTCTGAAGGTGAAGGA TCTGGTGAAGGTGGCGAAGGTGAGGGATCTGAAGGCG GCTCCGAAGGTGAAGGCGGATCTGAAGGCGGCGAAGG TGAAGGTTCCGAAGGTTCTGGTGAAGGTGAAGGATCTG AAGGTGGCTCCGAAGGTGAAGGATCTGAAGGCGGTTCC GAAGGTGAGGGCTCTGAAGGTTCTGGCGAAGGTGAAG GCTCTGAAGGATCTGGTGAAGGTGAGGATATTCTGCTG ACGCAAAGCCCTGTTATTCTGTCTGTTAGCCCGGGTGA GCGCGTTAGCTTCAGCTGCCGTGCATCTCAGAGCATTG GCACGAACATTCATTGGTATCAACAACGTACCAACGGT AGCCCGCGTCTGCTGATTAAATACGCATCCGAATCTAT CTCTGGTATCCCGTCTCGCTTCAGCGGTTCTGGTAGCGG CACCGACTTTACCCTGAGCATTAACTCTGTAGAAAGCG AAGATATTGCGGATTACTACTGCCAGCAGAACAACAAC TGGCCGACTACTTTTGGTGCAGGTACTAAACTGGAACT GAAAACCGGTTCTGGCGAAGGCTCTGAAGGTGAAGGTG GTGGTGAAGGCTCTGAAGGTGAAGGATCTGGTGAAGGT GGCGAAGGTGAGGGATCTGGTACCCAAGTGCAGCTGA AACAGAGCGGTCCGGGTCTGGTGCAACCATCCCAGTCT CTGTCTATTACCTGTACCGTTAGCGGTTTCTCCCTGACC AACTACGGTGTTCACTGGGTTCGCCAGTCCCCAGGCAA AGGCCTGGAATGGCTGGGCGTTATTTGGTCCGGCGGCA ATACGGATTATAACACCCCGTTCACCTCTCGTCTGTCTA TCAACAAGATAATTCTAAAAGCCAGGTATTCTTCAAG ATGAACTCTCTGCAGAGCAATGACACCGCCATCTACTA TTGCGCTCGTGCCCTGACTTACTACGATTACGAGTTCGC ATATTGGGGCCAGGGCACTCTGGTGACCGTTTCCGGCG | 717 | MEDIQMTQSPSSL SASVGDRVTITCR ASQDVNTAVAW YQQKPGKAPKLL IYSASFLYSGVPS RFSGSRSGTDFTL TISSLQPEDFATY YCQQHYTTPPTF GQGTKVEIKTGS GEGSEGEGGGEG SEGEGSGEGGEG EGSGTEVQLVES GGGLVQPGGSLR LSCAASGFNIKDT YIHWVRQAPGKG LEWVARIYPTNG YTRYADSVKGRF TISADTSKNTAYL QMNSLRAEDTAV YYCSRWGGDGF YAMDYWGQGTL VTVSGGEGSGEG SEGEGSEGSGEGE GSEGSGEGEGGS EGSEGEGGSEGSE GEGGSEGSEGEG SGEGSEGEGGEG GSEGEGSGEGSE GEGSEGGSEGEG GSEGSEGEGSE GSEGEGGEGGSE GEGSEGGSGEGE SGEGSEGEGSEGS GEGEGSGEGSEG EGSEGSGEGEGSE GSGEGEGGSEGS EGEGSSGEGE GGEGSGEGEGSG EGEGSEGGGEGS EGEGSGEGGEGE GSEGGSEGEGGS EGGEGEGSEGSG EGEGSEGGSEGE GSEGGSEGEGSE GSGEGEGSEGSG EGEDILLTQSPVIL SVSPGERVSFSCR ASQSIGTNIHWY QQRTNGSPRLLIK YASESISGIPSRFS GSGSGTDFTLSIN SVESEDIADYYC QQNNNWPTTFGA GTKLELKTGSGE GSEGEGGGEGSE GEGSGEGGEGEG SGTQVQLKQSGP GLVQPSQSLSITC TVSGFSLTNYGV HWVRQSPGKGLE WLGVIWSGGNTD YNTPFTSRLSINK DNSKSQVFFKMN SLQSNDTAIYYC | 742 |

TABLE 25-continued

DNA and amino acid sequences of binding fusion protein constructs

| Clone Name | DNA Sequence | SEQ ID NO: | Amino Acid Sequence | SEQ ID NO: |
|---|---|---|---|---|
| | GTTATCCTTATGATGTTCCAGACTATGCAGGTGGCTCTC ATCACCATCACCATCACTGA | | ARALTYYDYEFA YWGQGTLVTVS GGYPYDVPDYAG GSHHHHHH | |
| anti-Her2-Y288-anti-CD3-HA-His8, AC69 ("His8" disclosed as SEQ ID NO: 697) | ATGGAGGACATTCAGATGACCCAGAGCCCGTCCTCCCT GAGCGCTTCTGTTGGCGACCGCGTGACCATCACCTGCC GTGCTTCCCAGGATGTTAACACCGCTGTAGCTTGGTATC AACAGAAACCGGGCAAAGCACCGAAACTGCTGATCTA CTCTGCTTCCTTTCTGTATAGCGGTGTTCCGTCTCGTTTC AGCGGCTCTCGTAGCGGTACGGATTTTACTCTGACGAT CAGCTCTCTGCAGCCGGAGGACTTCGCTACCTACTACT GCCAGCAGCACTACACCACCCCGCCTACCTTTGGTCAG GGCACCAAAGTGGAAATCAAGACCGGTTCTGGCGAAG GCTCTGAAGGTGAAGGTGGTGGTGAAGGCTCTGAAGGT GAAGGATCTGGTGAAGGTGGCGAAGGTGAGGGATCTG GTACCGAGGTCCAGCTGGTTGAGTCTGGCGGCGGTCTG GTCCAACCTGGTGGCTCCCTGCGCCTGTCTTGCGCAGCG TCCGGCTTTAATATCAAAGATACGTACATTCACTGGGTC CGCCAGGCACCGGGCAAAGCCTGGAATGTTGCTCG TATCTACCCGACTAACGGTTATACCCGTTATGCAGACA GCGTAAAGGGTCGCTTCACGATCTCCGCGGATACCTCC AAAAACACCGCATACCTGCAAATGAACTCTCTGCGTGC GGAAGATACTGCCGTGTACTACTGCTCTCGCTGGGGCG GTGACGGTTTCTATGCAATGGACTACTGGGGTCAAGGT ACTCTGGTAACTGTTTCCGGGTCTCCAGGTGAGGGTTCT GGCGAAGGTTCCGAAGGTGAGGGCTCCGAAGGATCTG GCGAAGGTGAGGGTTCCGAAGGTTCTGGCGAAGGTGA AGGCGGTTCTGAGGGATCCGAAGGTGAAGGCGGTTCTG AGGGATCTGAAGGTGAAGGTGGCTCTGAAGGATCTGAA GGTGAGGGATCTGGTGAAGGTTCTGAAGGTGAAGGCG GCTCTGAGGGTTCTGAAGGTGAAGGATCTGGTGAAGGT TCCGAAGGTGAGGGTTCTGAAGGTGGTTCTGAAGGTGA AGGCGGTTCTGAGGGTTCTGAAGGTGAGGGTTCTGGCG AAGGTTCCGAAGGTGAAGGCGGCGAAGGTGGATCTGA AGGTGAGGGCTCCGAAGGATCTGGCGAAGGTGAAGGT TCTGGCGAAGGTTCCGAAGGTGAAGGTTCTGAAGGATC TGGCGAAGGTGAGGGTTCTGGCGAAGGTTCCGAAGGTG AGGGCTCCGAAGGATCTGGCGAAGGTGAGGGTTCCGA AGGTTCTGGCGAAGGTGAAGGCGGTTCTGAGGGATCCG AAGGTGAAGGCTCCGAAGGATCTGGCGAAGGTGAAGG TGGTGAAGGTTCTGGCGAAGGTGAGGGATCTGGCGAAG GCTCTGAAGGTGAAGGTGGTGGTGAAGGCTCTGAAGGT GAAGGATCTGGTGAAGGTGGCGAAGGTGAGGGATCTG AAGGCGGCTCCGAAGGTGAAGGCGGATCTGAAGGCGG CGAAGGTGAAGGTTCCGAAGGTTCTGGTGAAGGTGAAG GATCTGAAGGTGGCTCCGAAGGTGAAGGATCTGAAGGC GGTTCCGAAGGTGAGGGCTCTGAAGGTTCTGGCGAAGG TGAAGGCTCTGAAGGATCTGGTGAAGGTTCGTCTTCAC TCGAGGGTACCAAAGACATCCAGATGACCCAGTCTCCT TCCTCTCTGTCCGCGTCCGTGGGCGACCGTGTTACTATC ACCTGCTCCGCCTCCTCTTCTGTCAGCTACATGAACTGG TATCAGCAGACTCCTGGCAAAGCTCCAAAACGTTGGAT TTACGATACGTCCAAGCTGGCCTCCGGCGTACCAAGCC GTTTCTCTGGCTCTGGCAGCGGCACGGATTACACCTTCA CTATTTCTAGCCTGCAGCCTGAAGATATTGCCACCTATT ACTGCCAACAATGGTCCTCCAATCCTTTTACCTTTGGTC AGGGCACTAAGCTGCAGATTACTCGCACCGGTTCTGGC GAAGGCTCTGAAGGTGAAGGTGGTGGTGAAGGCTCTGA AGGTGAAGGATCTGGTGAAGGTGGCGAAGGTGAGGGA TCTGGTACCCAGGTCCAACTGGTTCAATCCGGCGGCGG TGTAGTTCAACCGGGTCGCTCTCTGCGTCTTTCCTGCAA GGCGTCCGGTTACACTTTCACGCGTTACACCATGCACTG GGTCCGTCAGGCTCCTGGTAAAGGTCTGGAATGGATTG GCTATATCAACCCGTCTCGCGGCTATACCAACTATAAC CAGAAATTCAAAGATCGTTTTACGATTTCCACTGATAA ATCCAAAAGCACCGCATTCCTCCAAATGGACAGCCTGC GTCCGGAAGACACCGGCGTTTATTATTCCGCCCGTTACT ACGATGACCACTACTGCCTGGATTATTGGGGCCAAGGC | 718 | MEDIQMTQSPSSL SASVGDRVTITCR ASQDVNTAVAW YQQKPGKAPKLL IYSASFLYSGVPS RFSGSRSGTDFTL TISSLQPEDFATY YCQQHYTTPPTF GQGTKVEIKTGS GEGSEGEGGGEG SEGEGSGEGGEG EGSGTEVQLVES GGGLVQPGGSLR LSCAASGFNIKDT YIHWVRQAPGKG LEWVARIYPTNG YTRYADSVKGRF TISADTSKNTAYL QMNSLRAEDTAV YYCSRWGGDGF YAMDYWGQGTL VTVSGSPGEGSG EGSEGEGSEGSGE GEGSEGSGEGEG GSEGSEGEGGSE GSEGSEGSEGSE GEGSGEGSEGEG GSEGSEGSEGSGE GSEGEGSEGGSE GEGGSEGSEGEG SGEGSEGEGGSE GSEGEGSEGSGE GEGSGEGSEGEG SEGSGEGSEGSGE GSEGEGSEGSGE GEGSGEGSEGEG GSEGSEGSGEGS GEGGEGGSEGG GSEGSEGEGSGEG EGGSEGSEGEG EGGSEGGEGEGS EGSGEGEGSEGG SEGEGSEGGSEGE GSEGSGEGEGSE GSGEGSSSLEGTK DIQMTQSPSSLSA SVGDRVTITCSAS SSVSYMNWYQQ TPGKAPKRWIYD TSKLASGVPSRFS GSGSGTDYTFIS SLQPEDIATYYCQ QWSSNPFTFGQG TKLQITRTGSGEG SEGEGGGEGSEG EGSGEGGEGEGS GTQVQLVQSGGG VVQPGRSLRLSC KASGYTFTRYTM HWVRQAPGKGL EWIGYINPSRGYT NYNQKFKDRFTIS TDKSKSTAFLQM | 743 |

TABLE 25-continued

DNA and amino acid sequences of binding fusion protein constructs

| Clone Name | DNA Sequence | SEQ ID NO: | Amino Acid Sequence | SEQ ID NO: |
|---|---|---|---|---|
| | ACTCCAGTAACCGTGAGCAGCACTAGTGGCGGTTATCC TTATGATGTTCCAGACTATGCAGGTGGCTCTCATCACCA TCACCATCACCACCATTGA | | DSLRPEDTAVYY SARYYDDHYCLD YWGQGTPVTVSS TSGGYPYDVPDY AGGSHHHHHHH H | |
| EGFR_VHH1-AM144-GFP6~229-H8, LMS109.005 | ATGAAAGGGTCTCCAGGTGAAGTACAGCTTCAAGAATC TGGTGGTGGTCTTGTCCAGGCGGGCGATTCCCTGCGCCT GTCTTGTCTGGTCTCTGGTCGTTCATTTAACAGCTATAC CATGGGCTGGTTCCGCCAAGCACCGGGCAAGGAACGTG AATTCGTAGCAGCTATTCTCTGGTCCGGTCCTACGACCT ACTATGCTGACTCTGTAAAAGGTCGCTTCACCATCTCCC GTGATAACGCCAAAAACACCGTATATCTTCAGATGAAC TCTCTGAAACCGGAGGACAGGCCGTGTACTATTGTGC CGCTGCGCTGGGTGTACTGGTGCTAGCGCCTGGTAATG TCTACAGCTATTGGGGTCAAGGTACCCAGGTCACGGTA AGCTCCGCGCATCATGGAGGTACCCCGGGCAGCGGTAC CGCATCTTCCTCTCCAGGTAGCTCTACCCCGTCTGGTGC TACCGGTTCCCCAGGTAGCTCTACCCCGTCTGGTGCAAC CGGCTCCCCAGGTAGCCCGGCTGCTCTCCTACCTCTAC TGAGGAAGGTACTTCTGAAAGCGCTACTCCTGAGTCTG GTCCAGGTACCTCTACTGAACCGTCCGAAGGTAGCGCT CCAGGTTCTAGCCCTTCTGCATCCACCGGTACCGGCCCA GGTTCTAGCCCGTCTGCTTCTACCGGTACTGGTCCAGGT GCTTCTCCGGGTACTAGCTCTACTGGTTCTCCAGGTACC TCTACCGAACCGTCCGAGGGTAGCGCACCAGGTACCTC TACTGAACCGTCTGAGGGTAGCGCTCCAGGTAGCGAAC CGGCAACCTCCGGTTCTGAAACTCCAGGTTCGTCTTCAC TCGAGGGTACCGAACTTTTCACTGGAGTTGTCCCAATTC TTGTTGAATTAGATGGTGATGTTAATGGGCACAAATTTT CTGTCAGTGGAGAGGGTGAAGGTGATGCAACATACGG AAAACTTACCCTTAAATTTATTTGCACTACTGGAAAACT ACCTGTTCCATGGCCAACACTTGTCACTACTTTCTCTTA TGGTGTTCAATGCTTTTCCCGTTATCCGGATCACATGAA ACGGCATGACTTTTTCAAGAGTGCCATGCCCGAAGGTT ATGTACAGGAACGCACTATATCTTTCAAAGATGACGGG AACTACAAGACGCGTGCTGAAGTCAAGTTTGAAGGTGA TACCCTTGTTAATCGTATCGAGTTAAAAGGTATTGATTT TAAAGAAGATGGAAACATTCTCGGACACAAACTCGAGT ACAACTATAACTCACACAATGTATACATCACGGCAGAC AAACAAAAGAATGGAATCAAAGCTAACTTCAAAATTCG CCACAACATTGAAGATGGATCCGTTCAACTAGCAGACC ATTATCAACAAAATACTCCAATTGGCGATGGCCCTGTC CTTTTACCAGACAACCATTACCTGTCGACACAATCTGCC CTTTCGAAAGATCCCAACGAAAGCGTGACCACATGGT CCTTCTTGAGTTTGTAACTGCTGCTGGGATTGGTGGCTC TCATCACCATCACCATCACTAA | 719 | MKGSPGEVQLQE SGGGLVQAGDSL RLSCLVSGRSFNS YTMGWFRQAPG KEREFVAAILWS GPTTYYADSVKG RFTISRDNAKNTV YLQMNSLKPEDT AVYYCAAALGV LVLAPGNVYSYW GQGTQVTVSSAH HGGTPGSGTASSS PGSSTPSGATGSP GSSTPSGATGSPG SPAGSPTSTEEGT SESATPESGPGTS TEPSEGSAPGSSP SASTGTGPGSSPS ASTGTGPGASPG TSSTGSPGTSTEP SEGSAPGTSTEPS EGSAPGSEPATSG SETPGSSSLEGTE LFTGVVPILVELD GDVNGHKFSVSG EGEGDATYGKLT LKFICTTGKLPVP WPTLVTTFSYGV QCFSRYPDHMKR HDFFKSAMPEGY VQERTISFKDDG NYKTRAEVKFEG DTLVNRIELKGID FKEDGNILGHKL EYNYNSHNVYIT ADKQKNGIKANF KIRHNIEDGSVQL ADHYQQNTPIGD GPVLLPDNHYLS TQSALSKDPNEK RDHMVLLEFVTA AGIGGSHHHHHH HH | 744 |
| EGFR_VHH1-AM144-GFP6~229-H8, LMS109.020 | ATGAAAGGGTCTCCAGGTGAAGTGCAGCTTCAAgAATC TGGTGGTGGTCTGGTACAAGCCGGTGATTCTCTGCGCCT GTCTTGTCTGGTCTCCGGTCGCTCTTTTAACAGCTATAC CATGGGCTGGTTCCGCCAGGCACCAGGCAAAGAGCGTG AATTCGTAGCAGCTATCCTGTGGTCTGGTCCGACTACCT ACTATGCTGACTCTGTAAAGGGTCGCTTCACGATTTCCC GTGATAACGCCAAAAACACGGTGTATCTACAAATGAAT TCTCTGAAACCGGAGGACACTGCCGTTTACTATTGTGCC GCTGCGCTGGGTGTACTGGTGCTTGCCCCTGGTAATGTA TACAGCTATTGGGGTCAAGGTACCAAGTCACCGTGAG CTCTGCGCATCATGGAGGTACTTCTACCGAACCGTCCG AGGGCAGCGCTCCAGGTACTTCTACTGAACCTTCTGAA GGCAGCGCTCCAGGTACTTCTACTGAACCTTCCGAAGG TAGCACCAGGTTCTACCAGCGAATCCCCTTCTGGCACCG CTGCTCCAGGTTCTACCAGCGAATCCCCTTCTGGCACCG CACCAGGTACTTCTACCCCTGAAAGCGGCTCCGCTTCTC CAGGTAGCGAACCTGCAACCTCTGGCTCTGAAACCCCA GGTACCTCTGAAAGCGGTACTCCTGAATCTGGCCAGC TACTTCTACTGAACCGTCCGAGGGCAGCGCACCAGGTA CTTCTACTGAACCGTCTGAAGGTAGCGCACCAGGTACT TCTGAAAGCGCAACCCCGGAATCCGGCCCAGGTACCTC TGAAAGCGCAACCCCGGAGTCCGGCCCAGGTTCGTCTT CACTCGAGGGTACCGAACTTTTCACTGGAGTTGTCCCA | 720 | MKGSPGEVQLQE SGGGLVQAGDSL RLSCLVSGRSFNS YTMGWFRQAPG KEREFVAAILWS GPTTYYADSVKG RFTISRDNAKNTV YLQMNSLKPEDT AVYYCAAALGV LVLAPGNVYSYW GQGTQVTVSSAH HGGTSTEPSEGSA PGTSTEPSEGSAP GTSTEPSEGSAPG STSESPSGTAPGS TSESPSGTAPGTS TPESGSASPGSEP ATSGSETPGTSES ATPESGPGTSTEP SEGSAPGTSTEPS EGSAPGTSESATP ESGPGTSESATPE SGPGSSSLEGTEL | 745 |

TABLE 25-continued

DNA and amino acid sequences of binding fusion protein constructs

| Clone Name | DNA Sequence | SEQ ID NO: | Amino Acid Sequence | SEQ ID NO: |
|---|---|---|---|---|
| | ATTCTTGTTGAATTAGATGGTGATGTTAATGGGCACAA<br>ATTTTCTGTCAGTGGAGAGGGTGAAGGTGATGCAACAT<br>ACGGAAAACTTACCCTTAAATTTATTTGCACTACTGGA<br>AAACTACCTGTTCCATGGCCAACACTTGTCACTACTTTC<br>TCTTATGGTGTTCAATGCTTTTCCCGTTATCCGGATCAC<br>ATGAAACGGCATGACTTTTTCAAGAGTGCCATGCCCGA<br>AGGTTATGTACAGGAACGCACTATATCTTTCAAAGATG<br>ACGGGAACTACAAGACGCGTGCTGAAGTCAAGTTTGAA<br>GGTGATACCCTTGTTAATCGTATCGAGTTAAAAGGTATT<br>GATTTTAAAGAAGATGGAAACATTCTCGGACACAAACT<br>CGAGTACAACTATAACTCACACAATGTATACATCACGG<br>CAGACAAACAAAAGAATGGAATCAAAGCTAACTTCAA<br>AATTCGCCACAACATTGAAGATGGATCCGTTCAACTAG<br>CAGACCATTATCAACAAAATACTCCAATTGGCGATGGC<br>CCTGTCCTTTTACCAGACAACCATTACCTGTCGACACAA<br>TCTGCCCTTTCGAAAGATCCCAACGAAAAGCGTGACCA<br>CATGGTCCTTCTTGAGTTTGTAACTGCTGCTGGGATTGG<br>TGGCTCTCATCACCATCACCATCACCATCACTAA | | FTGVVPILVELDG<br>DVNGHKFSVSGE<br>GEGDATYGKLTL<br>KFICTTGKLPVPW<br>PTLVTTFSYGVQ<br>CFSRYPDHMKRH<br>DFFKSAMPEGYV<br>QERTISFKDDGN<br>YKTRAEVKFEGD<br>TLVNRIELKGIDF<br>KEDGNILGHKLE<br>YNYNSHNVYITA<br>DKQKNGIKANFK<br>IRHNIEDGSVQLA<br>DHYQQNTPIGDG<br>PVLLPDNHYLST<br>QSALSKDPNEKR<br>DHMVLLEFVTAA<br>GIGGSHHHHHH<br>H | |
| EGFR_VHH1-<br>AM144-<br>GFP6~229-<br>H8,<br>LMS109.038 | ATGAAAGGGTCTCCAGGTGAGGTTCAACTTCaAgAATCT<br>GGTGGTGGTCTAGTACAAGCCGGCGACTCCCTGCGCCT<br>GTCTTGTCTGGTCTCCGGTCGTTCTTTTAACAGCTATAC<br>CATGGGCTGGTTCCGCCAAGCTCCGGGCAAGAACGTG<br>AATTCGTAGCAGCTATTCTCTGGTCTGGTCCTACCACCT<br>ACTATGCTGACTCTGTAAAGGGCCGTTTCACTATCTCCC<br>GTGATAACGCCAAAAACACTGTCTATCTGCAGATGAAT<br>TCTCTGAAACCGGAGGACACCGCAGTATACTATTGCGC<br>AGCTGCGCTGGGTGTACTGGTGCTCGCTCCAGGTAATG<br>TATACAGCTATTGGGTCAAGGTACGCAAGTCACGGTA<br>AGCTCTGCGCATCATGGAGGTACCCCGGGCAGCGTAC<br>CGCATCTTCCTCTCCAGGTAGCTCTACCCCGTCTGGTGC<br>TACCGGTTCCCCAGGTAGCTCTACCCCGTCTGGTGCAAC<br>CGGCTCCCCAGGTAGCCCGGCTGGCTCTCCTACCTCTAC<br>TGAGGAAGGTACTTCTGAAAGCGCTACTCCTGAGTCTG<br>GTCCAGGTACCTCTACTGAACCGTCCGAAGGTAGCGCT<br>CCAGGTTCTAGCCCTTCTGCATCCACCGGTACCGGCCCA<br>GGTTCTAGCCCGTCTGCTTCTACCGGTACTGGTCCAGGT<br>GCTTCTCCGGGTACTAGCTCTACTGGTTCTCCAGGTACC<br>TCTACCGAACCGTCCGAGGGTAGCGCACCAGGTACCTC<br>TACTGAACCGTCTGAGGGTAGCGCTCCAGGTAGCGAAC<br>CGGCAACCTCCGGTTCTGAAACTCCAGGTTCGTCTTCAC<br>TCGAGGGTACCGAACTTTTCACTGGAGTTGTCCCAATTC<br>TTGTTGAATTAGATGGTGATGTTAATGGGCACAAATTTT<br>CTGTCAGTGGAGAGGGTGAAGGTGATGCAACATACGG<br>AAAACTTACCCTTAAATTTATTTGCACTACTGGAAAACT<br>ACCTGTTCCATGGCCAACACTTGTCACTACTTTCTCTTA<br>TGGTGTTCAATGCTTTTCCCGTTATCCGGATCACATGAA<br>ACGGCATGACTTTTTCAAGAGTGCCATGCCCGAAGGTT<br>ATGTACAGGAACGCACTATATCTTTCAAAGATGACGGG<br>AACTACAAGACGCGTGCTGAAGTCAAGTTTGAAGGTGA<br>TACCCTTGTTAATCGTATCGAGTTAAAAGGTATTGATTT<br>TAAAGAAGATGGAAACATTCTCGGACACAAACTCGAGT<br>ACAACTATAACTCACACAATGTATACATCACGGCAGAC<br>AAACAAAAGAATGGAATCAAAGCTAACTTCAAAATTCG<br>CCACAACATTGAAGATGGATCCGTTCAACTAGCAGACC<br>ATTATCAACAAAATACTCCAATTGGCGATGGCCCTGTC<br>CTTTTACCAGACAACCATTACCTGTCGACACAATCTGCC<br>CTTTCGAAAGATCCCAACGAAAAGCGTGACCACATGGT<br>CCTTCTTGAGTTTGTAACTGCTGCTGGGATTGGTGGCTC<br>TCATCACCATCACCATCACCATCACTAA | 721 | MKGSPGEVQLQE<br>SGGGLVQAGDSL<br>RLSCLVSGRSFNS<br>YTMGWFRQAPG<br>KEREFVAAILWS<br>GPTTYYADSVKG<br>RFTISRDNAKNTV<br>YLQMNSLKPEDT<br>AVYYCAAALGV<br>LVLAPGNVYSYW<br>GQGTQVTVSSAH<br>HGGTPGSGTASSS<br>PGSSTPSGATGSP<br>GSSTPSGATGSPG<br>SPAGSPTSTEEGT<br>SESATPESGPGTS<br>TEPSEGSAPGSSP<br>SASTGTGPGSSPS<br>ASTGTGPGASPG<br>TSSTGSPGTSTEP<br>SEGSAPGTSTEPS<br>EGSAPGSEPATSG<br>SETPGSSSLEGTE<br>LFTGVVPILVELD<br>GDVNGHKFSVSG<br>EGEGDATYGKLT<br>LKFICTTGKLPVP<br>WPTLVTTFSYGV<br>QCFSRYPDHMKR<br>HDFFKSAMPEGY<br>VQERTISFKDDG<br>NYKTRAEVKFEG<br>DTLVNRIELKGID<br>FKEDGNILGHKL<br>EYNYNSHNVYIT<br>ADKQKNGIKANF<br>KIRHNIEDGSVQL<br>ADHYQQNTPIGD<br>GPVLLPDNHYLS<br>TQSALSKDPNEK<br>RDHMVLLEFVTA<br>AGIGGSHHHHHH<br>HH | 746 |
| EGFR_VHH1-<br>AM144-<br>GFP6~229-<br>H8,<br>LMS109.045 | ATGAAAGGGTCTCCAGGTGAAGTGCAACttcaAgAATCTG<br>GTGGTGGTCTGGTACAAGCTGGTGACTCTCTGCGCCTGT<br>CTTGTCTGGTCTCCGGTCGTTCCTTCAATAGCTATACCA<br>TGGGCTGGTTCCGCCAAGCTCCGGCAAAGAGCGTGAA<br>TTCGTAGCAGCAATCCTTTGGTCCGGTCCAACTACCTAC<br>TATGCTGACTCTGTAAAAGGTCGCTTCACCATCTCCCGT<br>GATAACGCCAAAAACACTGTTTATCTACAAATGAATTC<br>TCTGAAACGGAGGACACCGGCTGTTTACTACTGTGCTG<br>CCGCGCTGGGTGTACTGGTGCTCGCACCAGGTAATGTG | 722 | MKGSPGEVQLQE<br>SGGGLVQAGDSL<br>RLSCLVSGRSFNS<br>YTMGWFRQAPG<br>KEREFVAAILWS<br>GPTTYYADSVKG<br>RFTISRDNAKNTV<br>YLQMNSLKPEDT<br>AVYYCAAALGV | 747 |

TABLE 25-continued

DNA and amino acid sequences of binding fusion protein constructs

| Clone Name | DNA Sequence | SEQ ID NO: Amino Acid Sequence | SEQ ID NO: |
|---|---|---|---|
| | TACAGCTATTGGGGTCAAGGTACCCAGGTGACGGTCAG | LVLAPGNVYSYW | |
| | CTCTGCGCATCATGGAGGTAGCCCGGCAGGCTCTCCGA | GQGTQVTVSSAH | |
| | CCTCTACTGAGGAAGGTACTTCTGAAAGCGCAACCCCG | HGGSPAGSPTSTE | |
| | GAGTCCGGCCCAGGTACCTCTACCGAACCGTCTGAGGG | EGTSESATPESGP | |
| | CAGCGCACCAGGTACTTCTGAAAGCGCAACCCCTGAAT | GTSTEPSEGSAPG | |
| | CCGGTCCAGGTAGCGAACCGGCTACTTCTGGCTCTGAG | TSESATPESGPGS | |
| | ACTCCAGGTACTTCTACCGAACCGTCCGAAGGTAGCGC | EPATSGSETPGTS | |
| | ACCAGGTAGCCCGGCTGGTTCTCCGACTTCCACCGAGG | TEPSEGSAPGSPA | |
| | AAGGTACCTCTACTGAACCTTCTGAGGGTAGCGCTCCA | GSPTSTEEGTSTE | |
| | GGTACCTCTACTGAACCTTCCGAAGGCAGCGCTCCAGG | PSEGSAPGTSTEP | |
| | TACTTCTACCGAACCGTCCGAGGGCAGCGCTCCAGGTA | SEGSAPGTSTEPS | |
| | CTTCTACTGAACCTTCTGAAGGCAGCGCTCCAGGTACTT | EGSAPGTSTEPSE | |
| | CTACTGAACCTTCCGAAGGTAGCGCACCAGGTTCGTCT | GSAPGTSTEPSEG | |
| | TCACTCGAGGGTACCGAACTTTTCACTGGAGTTGTCCCA | SAPGSSSLEGTEL | |
| | ATTCTTGTTGAATTAGATGGTGATGTTAATGGGCACAA | FTGVVPILVELDG | |
| | ATTTTCTGTCAGTGGAGAGGGTGAAGGTGATGCAACAT | DVNGHKFSVSGE | |
| | ACGGAAAACTTACCCTTAAATTTATTTGCACTACTGGA | GEGDATYGKLTL | |
| | AAACTACCTGTTCCATGGCCAACACTTGTCACTACTTTC | KFICTTGKLPVPW | |
| | TCTTATGGTGTTCAATGCTTTTCCCGTTATCCGGATCAC | PTLVTTFSYGVQ | |
| | ATGAAACGGCATGACTTTTTCAAGAGTGCCATGCCCGA | CFSRYPDHMKRH | |
| | AGGTTATGTACAGGAACGCACTATATCTTTCAAAGATG | DFFKSAMPEGYV | |
| | ACGGGAACTACAAGACGCGTGCTGAAGTCAAGTTTGAA | QERTISFKDDGN | |
| | GGTGATACCCTTGTTAATCGTATCGAGTTAAAAGGTATT | YKTRAEVKFEGD | |
| | GATTTTAAAGAAGATGGAAACATTCTCGGACACAAACT | TLVNRIELKGIDF | |
| | CGAGTACAACTATAACTCACACAATGTATACATCACGG | KEDGNILGHKLE | |
| | CAGACAAACAAAAGAATGGAATCAAAGCTAACTTCAA | YNYNSHNVYITA | |
| | AATTCGCCACAACATTGAAGATGGATCCGTTCAACTAG | DKQKNGIKANFK | |
| | CAGACCATTATCAACAAAATACTCCAATTGGCGATGGC | IRHNIEDGSVQLA | |
| | CCTGTCCTTTTACCAGACAACCATTACCTGTCGACACAA | DHYQQNTPIGDG | |
| | TCTGCCCTTTCGAAAGATCCCAACGAAAAGCGTGACCA | PVLLPDNHYLST | |
| | CATGGTCCTTCTTGAGTTTGTAACTGCTGCTGGGATTGG | QSALSKDPNEKR | |
| | TGGCTCTCATCACCATCACCATCACCATCACTAA | DHMVLLEFVTAA | |
| | | GIGGSHHHHHHH | |

Example 26

Purification of aIL6R-XTEN

E. coli from a single colony containing either: AC341, AC342, AC361, or AC362 were grown to saturation in 2xYT media. 10 mL of this saturated overnight culture was used to inoculate a 500 ml of 2xYT media and this culture was grown to an OD600 between 0.4 and 0.5 at 37° C., transferred to 26° C. and induced with 1 mM IPTG. The culture was then grown overnight (15-17 hours) and harvested by centrifugation at 10,000 rpm in a Sorvall SLA-3000 rotor. The pellets were stored until use at −80° C. Cell paste was resuspended in 25 ml of lysis buffer (20 mM sodium acetate, 50 mM sodium chloride, pH 4.5), lysed by sonication, and clarified by spinning at 10,000 rpm at 4° C. in a Sorvall SS34 rotor. The samples were further acidified by the addition of acetic acid. The sample was further clarified by centrifugation and the supernatant loaded onto a 15 mL DE52 column equilibrated with 20 mM sodium acetate, 50 mM sodium chloride, pH 4.5. The column was washed with 2 columns volumes of 20 mM sodium acetate, 50 mM sodium chloride, pH 4.5, washed with four columns volumes of 20 mM sodium acetate, 100 mM sodium chloride, pH 4.5, and eluted with four columns volumes of 20 mM sodium acetate, 150 mM sodium chloride, pH 4.5. Sodium sulfate was added to the elution fractions to a final concentration of 1M and the sample loaded onto a phenyl HIC column. The column was washed with five column volumes of 20 mM sodium acetate, 1M sodium sulfate pH 4.5, and eluted with four column volumes of 20 mM sodium acetate, 0.5M sodium sulfate pH 4.5. The samples were exchanged in to assay buffer, assigned lots numbers AP342, AP343, AP344 and AP345 and stored frozen at −80° C.

Example 27

Purification of aHER2-XTEN-GFP

AC62 was grown to saturation overnight in 2xYT+kanamycin. Two 500 mL flasks of 2xYT were inoculated with 3 ml of this saturated overnight and grown to an OD600 of ~0.8 at 37° C. The culture was brought to 25° C. and then induced with 1 mM IPTG. The culture was induced overnight. The cell pellet was harvested by centrifugation at 5000 rpm, in a Sorvall SLA-3000 at 4° C. as pellet EP52. The cell pellet was then resuspended in 30 mM Tris pH 8.0, 500 mM NaCl, 20 mM imidazole. The cells were lysed by sonication and then clarified by centrifugation at 15,000 rpm in a Sorvall SS34 rotor. The supernatant was loaded onto a 5 ml Ni-NTA column, washed with 20 column volumes of 30 mM Tris pH 8.0, 500 mM NaCl, 20 mM imidazole, and eluted with 30 mM Tris pH 8.0, 500 mM NaCl, 600 mM imidazole. The elution fractions were diluted 1:2 with 20 mM histidine pH 5.6, and loaded onto an anion exchange column equilibrated with 20 mM histidine pH 5.6. The column was washed with 20 mM histidine pH 5.6, 20 column volumes of 20 mM histidine pH 5.6, 150 mM NaCl, 20 column volumes of 20 mM histidine pH 5.6, 300 mM NaCl, and then eluted with 20 mM histidine pH 5.6, 600 mM NaCl. This protein was assigned lot # AP60 and stored frozen.

Example 28

Purification of aCD3-XTEN-GFP

AC50 was grown to saturation overnight in 2xYT+kanamycin. A 500 mL flask of 2xYT was inoculated with 3 ml of this saturated overnight and grown to an OD600 of ~0.8 at 37° C. The culture was brought to 25° C. and then induced with 0.2 mM IPTG. The culture was induced overnight. The cell pellet was harvested by centrifugation at 5000 rpm, in a Sorvall SLA-3000 at 4° C. The cell pellet was then resuspended in 30 mM Tris pH 8.0, 500 mM NaCl, 20 mM imidazole. The cells were lysed by sonication and then clarified by centrifugation at 15,000 rpm in a Sorvall SS34 rotor. The supernatant was loaded onto Ni-NTA column, washed with 10 column volumes of 30 mM Tris pH 8.0, 500 mM NaCl, 20 mM imidazole, and eluted with 30 mM Tris pH 8.0, 500 mM NaCl, 600 mM imidazole. This protein was assigned lot # AP43.

Example 29

Purification of aHER2-XTEN-aEGFR

Figure 17A:
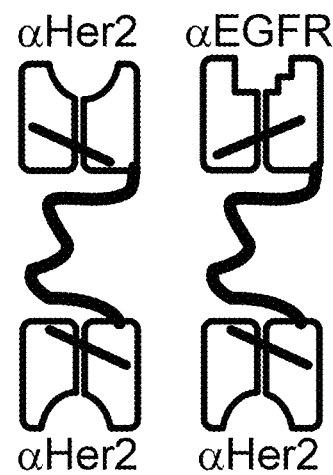
FIG. 17A is a schematic representation of two variations of multivalent scFv binding fusion proteins, with a monospecific construct on the left comprising two targeting moieties directed to HER2 and a bispecific construct on the right comprising a targeting moiety to HER2 and a second targeting moiety to EGFR.
Figure 17B:
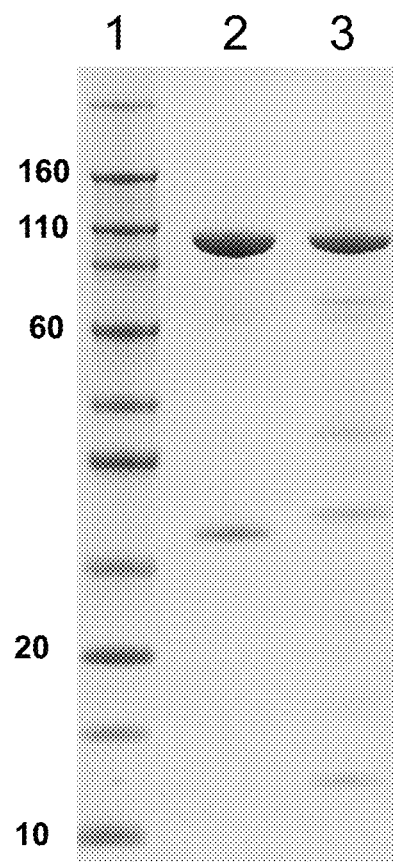
FIG. 17B shows an SDS-PAGE of materials following purification, as described in Example 29. Lane 1 shows the molecular weight standards, lane 2 shows the purified aHER2-XTEN-aHER2, and lane 3 shows the purified bispecific aHER2-XTEN-aEGFR.
Figure 17C:
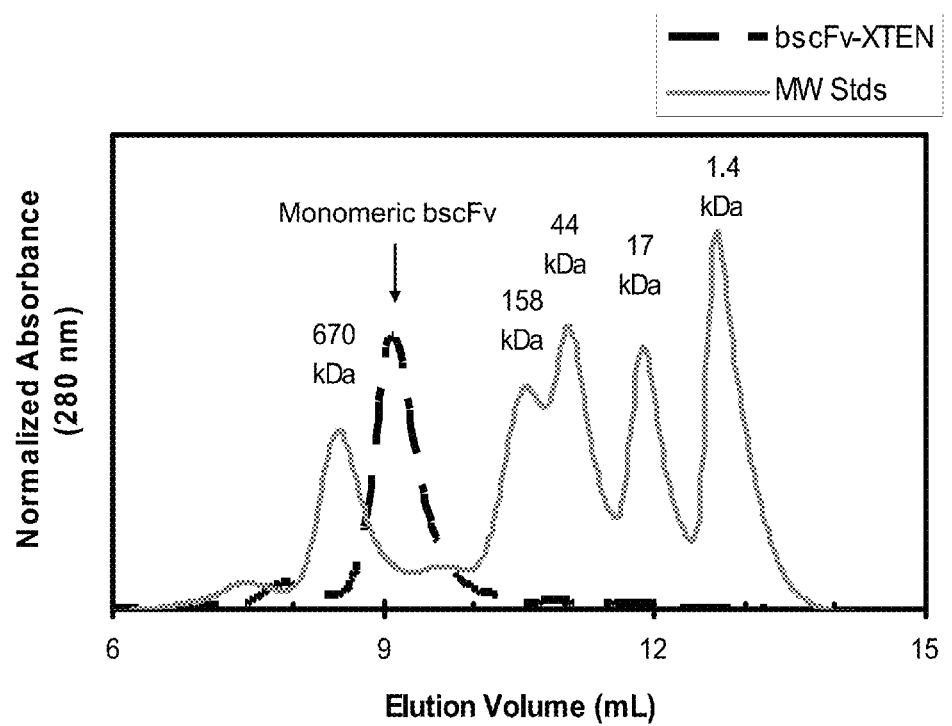
FIG. 17C shows the results of SEC analysis of aHER2-XTEN-aEGFR compared to molecular weight standards, and demonstrates that no dimers or other higher-order oligomers are formed and that the protein has an approximate apparent molecular weight of approximately 500 kDa, as described in Example 37.

AC49 was grown to saturation overnight in 2xYT+kanamycin. A 500 mL flask of 2xYT was inoculated with 3 ml of this saturated overnight and grown to an OD600 of ~0.8 at 37° C. The culture was brought to 25° C. and then induced with 0.2 mM IPTG. The culture was induced overnight. The cell pellet was harvested by centrifugation at 5000 rpm, in a Sorvall SLA-3000 at 4° C. as pellet EP36. The cell pellet was then resuspended in 30 mM Tris pH 8.0, 500 mM NaCl, 20 mM imidazole. The cells were lysed by sonication and then clarified by centrifugation at 15,000 rpm in a Sorvall SS34 rotor. The supernatant was loaded onto a 5 ml Ni-NTA column, washed with 10 column volumes of 30 mM Tris pH 8.0, 500 mM NaCl, 20 mM imidazole, and eluted with 30 mM Tris pH 8.0, 500 mM NaCl, 600 mM imidazole. The elution fractions were diluted 1:3 with 20 mM histidine pH 5.6, and loaded onto a 1 mL DEAE column equilibrated with 20 mM histidine pH 5.6, 200 mM NaCl. The column was washed with five column volumes of 20 mM histidine pH 5.6, 400 mM NaCl and five column volumes of 20 mM histidine pH 5.6, 600 mM NaCl, and then eluted with 20 mM histidine pH 5.6, 700 mM NaCl. This protein was assigned lot # AP41. The final purified aHER2-XTEN-aEGFR protein was subjected to non-reducing SDS-PAGE using NuPAGE 4-12% Bis-Tris gel from Invitrogen according to manufacturer's specifications. The results, as shown in Lane 3 of FIG. 17B (compared to aHER2-XTEN-aHER2-XTEN in Lane 2) demonstrate that the protein was recovered at >95% purity by the process detailed above. Results of SEC analysis of the purified material, performed as described in Example 36, are shown in FIG. 17C, and demonstrate that the binding fusion protein was recovered in monomeric form and has an apparent molecular weight of approximately 500 kDa, far in excess of its actual molecular weight.

Example 30

Purification of aCD3-XTEN-aHER2

AC59 was grown to saturation overnight in 2xYT+kanamycin. A 10 L culture of 2xYT in wavebag was inoculated with this saturated overnight and grown to an OD600 of 1.3 at 37° C. The culture was brought to 25° C. and then induced with 1 mM IPTG. The culture was induced overnight. The cell pellet was harvested by centrifugation at 5000 rpm, in a Sorvall SLA-3000 at 4° C. and stored as pellet EP50. The cell pellet was then resuspended in 20 mM Tris pH 8.0, 50 mM NaCl, plus Roche complete protease inhibitors. The cells were lysed by sonication and then clarified by centrifugation at 15,000 rpm in a Sorvall SSR-15 rotor. The supernatant was loaded onto a 60 ml Ni-NTA column, washed with 11 column volumes of 20 mM Tris pH 8.0, 50 mM NaCl; 10 column volumes of 20 mM Tris pH 8.0, 500 mM NaCl; 10 column volumes of 20 mM Tris pH 8.0, 1% triton X-114; 10 column volumes of 20 mM Tris pH 8.0, 5 mM imidazole; 10 column volumes of 20 mM Tris pH 8.0, 50 mM NaCl, 10 mM imidazole, and eluted with 20 mM Tris pH 8.0, 50 mM NaCl, 200 mM imidazole. The elution fractions were diluted with 20 mM histidine pH 6.2, and triton-X114 extracted to remove endotoxin as follows: bring to 5% detergent on ice, warm to 37° C. to cloud, phase separate by centrifugation at room temp at 3000 rpm in a Sorvall bench top centrifuge, transfer top aqueous phase, repeat process 3 times. The final aqueous layer was diluted with 20 mM histidine pH 6.2 and loaded onto a 7.5 mL Q-sepharose FF column equilibrated with 20 mM histidine pH 6.2, 20 mM NaCl. The column was washed with 11 column volumes of 20 mM histidine pH 6.2, 20 mM NaCl, 10 column volumes of 20 mM histidine pH 6.2, 50 mM NaCl, and 10 column volumes of 20 mM histidine pH 6.2, 100 mM NaCl, then eluted with 20 mM histidine pH 5.6, 600 mM NaCl. The protein was then further purified by running a mono-Q column on an AKTA purifier system. The column and system were sanitized with 10 column volumes of 0.5 NaOH and the protein loaded in 20 mM histidine pH 6.0 and eluted with a linear salt gradient. The viable fractions were pooled and triton extracted as above, to further reduce endotoxin. This protein was assigned lot # AP58.

Example 31

Purification of aHER2-XTEN-aHER2

AC47 was grown to saturation overnight in 2xYT+kanamycin. A 500 mL flask of 2xYT was inoculated with 3 ml of this saturated overnight and grown to an OD600 of ~0.8 at 37° C. The culture was brought to 25° C. and then induced with 1 mM IPTG. The culture was induced overnight. The cell pellet was harvested by centrifugation at 5000 rpm, in a Sorvall SLA-3000 at 4° C. and stored as EP35. The cell pellet was then resuspended in 30 mM Tris pH 8.0, 500 mM NaCl, 20 mM imidazole. The cells were lysed by sonication and then clarified by centrifugation at 15,000 rpm in a Sorvall SS34 rotor. The supernatant was loaded onto a 5 ml Ni-NTA column, washed with 10 column volumes of 30 mM Tris pH 8.0, 500 mM NaCl, 20 mM imidazole, and eluted with 30 mM Tris pH 8.0, 500 mM NaCl, 600 mM imidazole. The elution fractions were diluted 1:3 with 20 mM histidine pH 5.6, and loaded onto a 1 mL DEAE column equilibrated with 20 mM histidine pH 5.6, 200 mM NaCl. The column was washed with five column volumes of 20 mM histidine pH 5.6, 400 mM NaCl and five column volumes of 20 mM histidine pH 5.6, 600 mM NaCl, and then eluted with 20 mM histidine pH 5.6, 700 mM NaCl. This protein was assigned lot # AP40.

Example 32

Purification of Multivalent aEGFR Vhh Binders

Protein from constructs LCW501.001, LCW502.009, LCW503.004, LCW504.004, and LCW505.002 were expressed as follows: Nine 96 well plates with 0.5 ml in each well were grown for each construct. Plates were filled by inoculating 40 ml of saturated overnight in SB into 1 L of auto induction media and then using the Q-fill to load the plates. The samples were sealed with a breathable membrane and then placed at 26 C overnight shaking at 300 rpm. The plates were then pooled into one large bucket and poured into a single centrifuge bottle for harvesting. The cultures were spun at 10,000 rpm in the Sorvall RC-5B centrifuge for 20 mins (GS-3 rotor) to pellet the cells. Approximately 15 g of cell mass was obtained. The cells were resuspended in lysis buffer (20 mM phosphate pH 7.4, 500 mM NaCl, 5 mM imidazole, 0.5 mM EDTA and 1 complete Roche protease mini tablet per 10 ml). The samples were then lysed by sonication (5×20 seconds on, 40 seconds off at power setting 8 with the large probe). The samples were kept on ice, but still warmed to ~25 during the process. The lysates were then spun at 15,000 rpm in the SS-34 rotor using a Sorvall RC-5B centrifuge to clarify.

2 mL Ni-NTA columns were equilibrated in 10 CV's of lysis buffer and then the lysates from LCW503, LCW504 and LCW505 were loaded. The columns were washed with 10 CV's of lysis buffer, 3 CV's of PBS+5 mM imidazole to reduce salt, and then were eluted with PBS+300 mM imidazole. The elution was tracked by GFP such that all of the fluorescence was captured in on fraction. The elutions were held overnight. The following day 3×3 ml (LCW503, LCW504, LCW505) and 2×5 ml (LCW501 and LCW502) Ni-NTA columns were equilibrated in 10 CV's of lysis buffer and then the lysates from LCW503, LCW504 and LCW505 were loaded. The columns were washed with 50 ml of lysis buffer, 15 ml of PBS+5 mM imidazole to reduce salt, and then were eluted with PBS+300 mM imidazole. The elution was tracked by GFP such that all of the fluorescence was captured in on fraction. The elutions from day one for 503, 504 and 505 were pooled with the second day elutions.

The samples were then purified with anion exchange chromatography. A 1 ml mono Q column was used for all of the preps. Buffer A was always 20 mM Tris pH 8.0 and buffer B was always 20 mM Tris pH 8.0 and 1M NaCl. The AKTA purifier system was used with a 10 ml super loop. All runs involved loading with 12 ml injection (regardless of sample volume), washing with 2 CV's of buffer A, a gradient to 50% B over 20 CV's, and finally Then a 5 CV washout with 100% B. The column was then re-equilibrated with buffer A between runs. The super loop was disassembled and clean and the tubing flushed to avoid carry over between runs. The fractions were pooled and stored overnight at 4 C. The next day the samples concentrated in an Amicon ultra 30,000 MWCO concentrator at 4000 rpm in the Sorvall T21. The concentrated sample was loaded on gel filtration columns. The columns were TSK3000 for LCW501 and LCW502 and TSK4000 for LCW503, LCW504 and LCW505. Fractions were pooled, concentrated and frozen for storage at −80° C.

Example 33

Characterization of aIL6R-XTEN

Figure 28A:
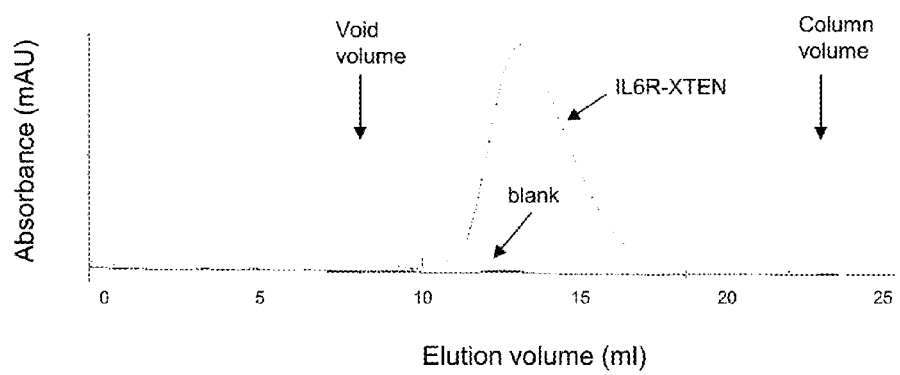
FIG. 28A shows the uniformity of the purified protein assessed by SEC, which showed a monodispersed peak with minimal contamination.
Figure 28B:
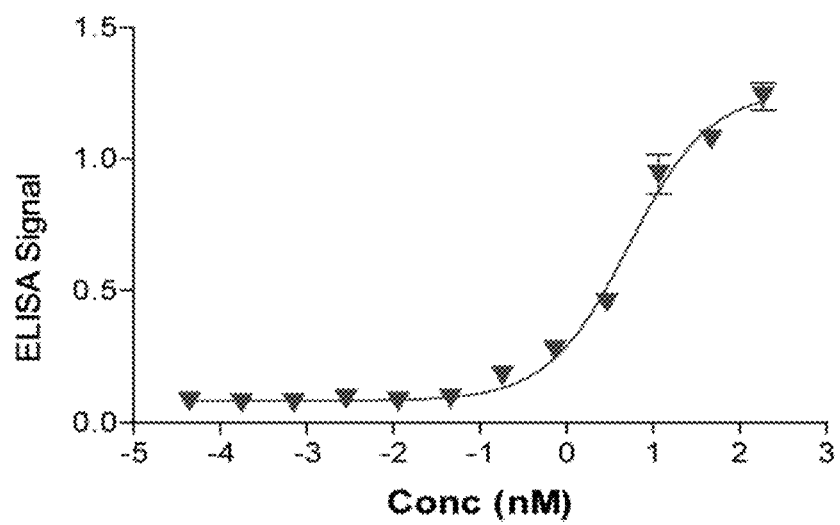
FIG. 28B shows results of an ELISA binding assay of the anti-IL6R binding fusion protein against human IL6R, as described in Example 33.
Figure 29:
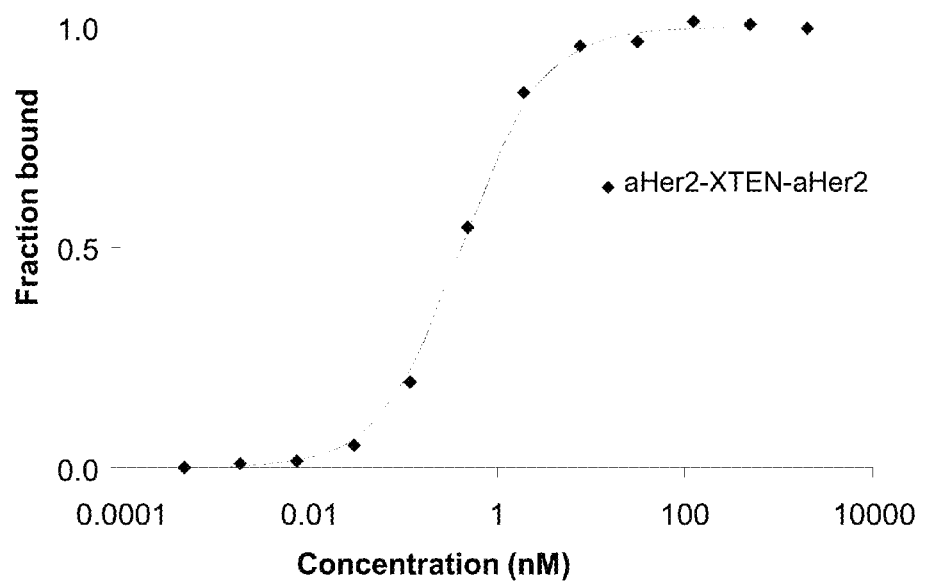
FIG. 29 shows the results of a binding characterization ELISA assay of anti-Her2 binding protein with two anti-Her2 targeting moieties against human HER2, as described in Example 35.

E. coli from a single colony of AC342 was grown to saturation in 2xYT media. 10 mL of this saturated overnight culture was used to inoculate a 500 ml of 2xYT media and this culture was grown to an OD600 between 0.4 and 0.5 at 37° C., transferred to 26° C. and induced with 1 mM IPTG. The culture was then grown overnight (15-17 hours) and harvested by centrifugation at 10,000 rpm in a Sorvall SLA-3000 rotor. The pellets were stored until use at −80° C. Cell paste was resuspended in 25 ml of lysis buffer (20 mM sodium acetate, 50 mM sodium chloride, pH 4.5), lysed by sonication, and clarified by spinning at 10,000 rpm at 4° C. in a Sorvall SS34 rotor. The samples were further acidified by the addition of acetic acid. The sample was further clarified by centrifugation and the supernatant loaded onto a 15 mL DE52 column equilibrated with 20 mM sodium acetate, 50 mM sodium chloride, pH 4.5. The column was washed with 2 columns volumes of 20 mM sodium acetate, 50 mM sodium chloride, pH 4.5, washed with four columns volumes of 20 mM sodium acetate, 100 mM sodium chloride, pH 4.5, and eluted with four columns volumes of 20 mM sodium acetate, 150 mM sodium chloride, pH 4.5. Uniformity was assessed by SEC, which showed a monodispersed peak with minimal contamination (FIG. 28A). IL6R binding was assessed in an ELISA as follows: the plates were coated with either 100 ng/well of human IL6R for 1 hour at 37° C., blocked with 3% BSA in PBS for one hour at 37° C., bound by adding the AC342 dilution series to the plate and incubating for one hour at room temperature, washed 3 times with PBST, detected with biotinylated anti-XTEN antibody for one hour at room temperature, washed three times with PBST, amplified with streptavidin-HRP for one hour at room temperature, washed three times with PBST, developed with TMB substrate and read at 405 nm using a plate reader. The ELISA values were plotted versus concentration (log scale), which provided determination of an EC50 value of 5 nM (FIG. 28B).

Example 34

Characterization of aCD40-XTEN

Figure 27:
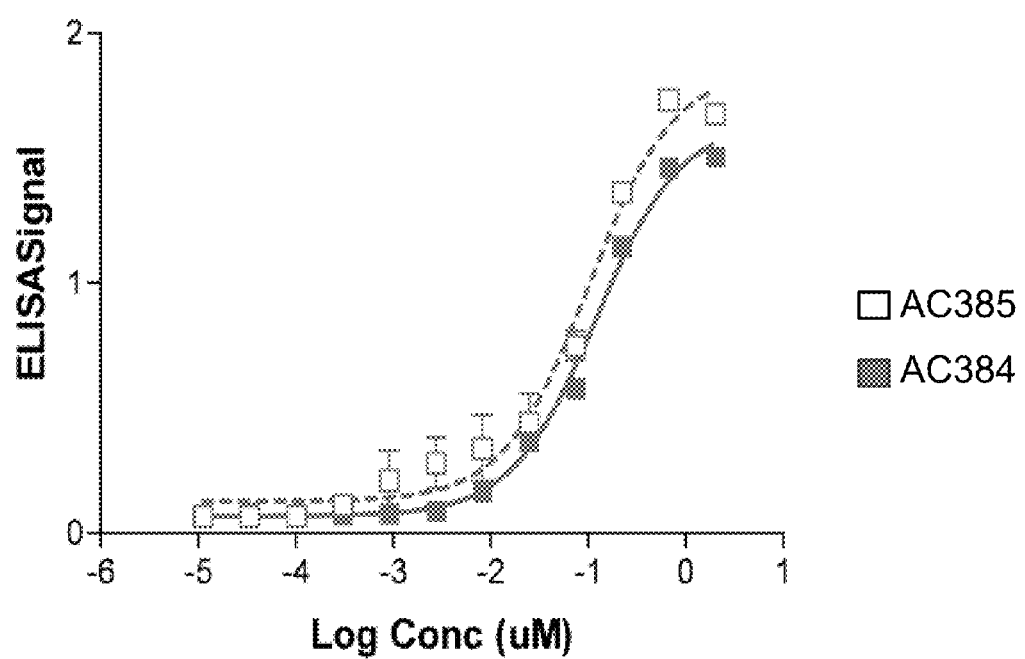
FIG. 27 shows the results of a binding characterization ELISA assay of two anti-CD40 scFv binding fusion protein constructs, AC384 (closed squares) and AC385 (open squares), against human CD40, as described in Example 34.

Two aCD40-XTEN constructs, AC384 and AC385, were expressed by growing a culture to saturation in 2xYT and then using this culture to inoculate a 500 ml flask of 2xYT. This second flask was grown to an OD600 of between 0.6 and 1.0 at 37° C., transferred to 26° C., and induced with 1 mM IPTG. The induction was left overnight and cell paste harvested by centrifugation the flowing morning. These pellets were stored as EP220 and EP221. Small samples were taken from the pellet, lysed using bugbuster, and clarified using a microcentrifuge. These cleared lysates were the serially diluted by a factor of three in PBST, for using in a binding ELISA. The ELISA was performed as follows: The plates were coated with either 100 ng/well of human CD40-Fc fusion for 1 hour at 37° C., blocked with 3% BSA in PBS for one hour at 37° C., bound by adding the AC384 or AC385 dilution series to the plate and incubating for one hour at room temperature, washed 3 times with PBST, detected with biotinylated anti-XTEN antibody for one hour at room temperature, washed three times with PBST, amplified with streptavidin-HRP for one hour at room temperature, washed three times with PBST, developed with TMB substrate and read at 405 nm using a plate reader. The ELISA values were plotted versus dilution of lysate plotted on a log scale and an EC50 value determined, with nearly identical results (FIG. 27). Combining this with an estimate concentration of 10 μM in the lysate, the aCD40-XTEN constructs have a Kd of approximately 50 nM for human CD40.

Example 35

Characterization of aHER2-XTEN-aHER2

Figure 18:
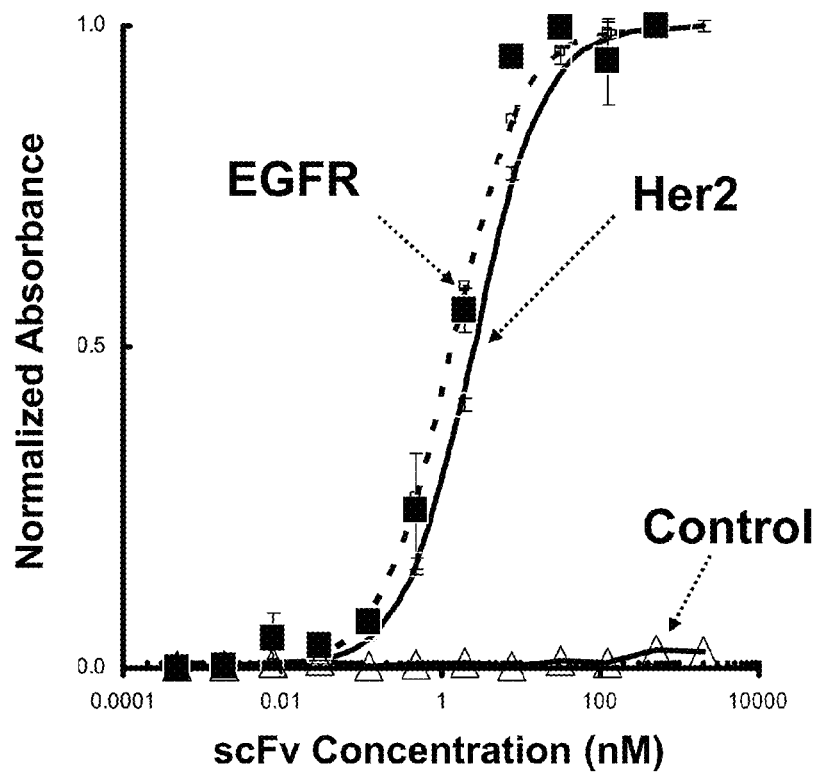
FIG. 18 shows results of a binding activity assay of aHER2-XTEN-aEGFR bispecific binding fusion protein to its respective targets using an ELISA format, as described in Example 37.

Binding of the aHER2-XTEN-aHER2 protein to human HER2 was assessed by ELISA as follows: The plates were coated with either 100 ng/well of human HER2-Fc fusion overnight at 4° C., blocked with 1% BSA in PBS for one hour at room temperature, bound by adding a dilution series of aHER2-XTEN-aHER2 to the plate and incubating for one hour at room temperature, washed 3 times with PBST, detected with anti-HA antibody with HRP conjugation for one hour at room temperature, washed three times with PBST, washed three times with PBST, developed with ABTS substrate and read at 405 nm using a plate reader. The ELISA values were plotted versus concentration plotted on a log scale and an EC50 of 0.5 nM determined (FIG. 18).

Example 36

Characterization of aCD3-XTEN-aHER2

Figure 19A:
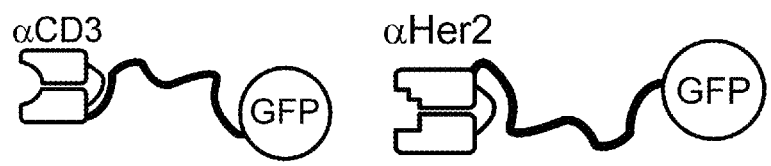
FIG. 19A is a schematic of aCD3-XTEN-GFP and aHER2-XTEN-GFP constructs.
Figure 19B:
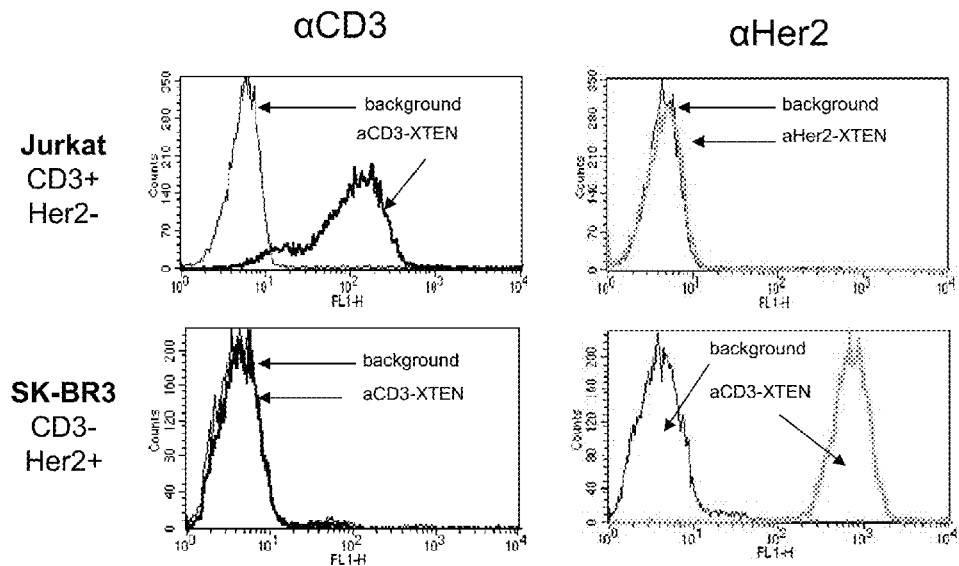
FIG. 19B shows the output of flow-cytometry in which the two constructs were individually reacted with Jurkat CD3+ and SK-BR3 HER2+ cells, as described in Example 36, demonstrating the binding specificity of the respective constructs towards their ligands and the lack of binding to the heterologous targets.

To confirm the binding specificity of expressed and purified binding fusion proteins with scFv targeting moieties, two preparations directed to the targets HER2 or CD3 were evaluated. Binding fusion proteins of aHER2 linked to the N-terminus of XTEN, with GFP linked to the C-terminus of the XTEN ("aHER2-XTEN-GFP"), and aCD3 linked to the N-terminus of XTEN, with GFP linked to the C-terminus of the XTEN ("aCD3-XTEN-GFP") were the test articles that were evaluated for their ability to bind their respective targets on Jurkat cells bearing CD3 and SK-BR-3 cells bearing HER2. Jurkat cells and SK-BR3 cells were incubated with the indicated scFv-XTEN-GFP fusion proteins. Bound aCD3-XTEN-GFP and aHER2-XTEN-GFP were detected with a polyclonal anti-GFP antibody specific for the GFP fused to the construct, and an appropriate FITC-conjugated secondary antibody using flow cytometry. The flow cytometry results, shown graphically in FIG. 19B, demonstrate specific binding of the aCD3-XTEN-GFP to Jurkat cells and specific binding of the aHER2-XTEN-GFP to SK– BR-3 cells, respectively, while there was no non-specific binding detected in the opposite configuration, indicating lack of cross-reactivity by the constructs.

A bispecific binding fusion protein with scFv targeting moieties to both HER2 and CD3 ("aCD3-XTEN-aHER2", matching the N— to C-terminus configuration of the fusion protein components) was recovered by the purification process detailed above and the protein characterized. The aCD3-XTEN-aHER2 protein was subjected to non-reducing SDS-PAGE using NuPAGE 4-12% Bis-Tris gel from Invitrogen according to manufacturer's specifications. The results, shown in FIG. 20A demonstrate that the protein was >95% pure, as judged by SDS-PAGE. FIG. 20B shows the output of a size exclusion chromatography (SEC) analysis of the aHER2-aCD3-XTEN compared to molecular weight standards, and demonstrates that no dimers or other higher-order oligomers are formed and that the protein has an approximate apparent molecular weight of approximately 500 kDa, approximately five-fold higher than that derived from the SDS-PAGE assay.

Figure 21A:
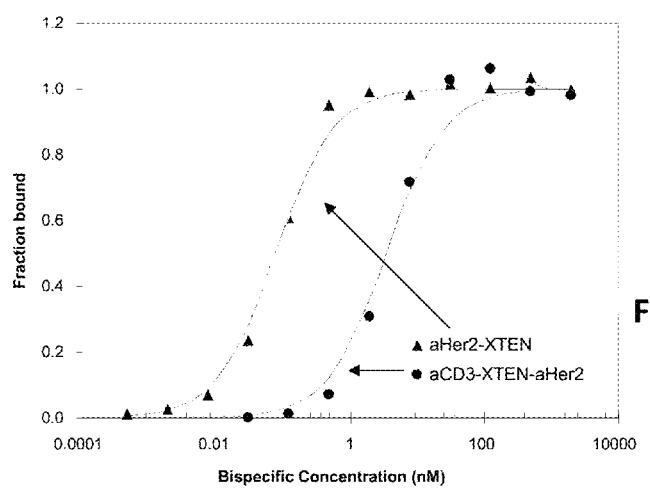
FIG. 21A shows results of a binding assay performed by ELISA comparing a scFv of anti-Her2 on the N-terminus of a binding fusion protein to a bispecific scFv of anti-CD3 on the N-terminus and anti-Her2 on the C-terminus of an XTEN, against wells coated with HER2, showing that the bispecific retains binding affinity to the HER2 target.
Figure 21B:
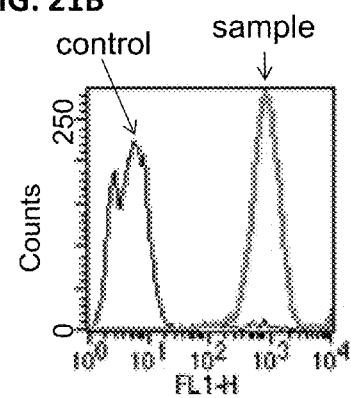
FIGS. 21B and C show results of a flow cytometry cell binding assays using the mono- and bispecific constructs, respectively, against HER2-expressing SK-BR-3 cells. The results show greater signal for the N-terminal anti-Hers scFv-XTEN (FIG. 21B) than the bispecific construct, consistent with that of the ELISA study, but that the bispecific construct nevertheless retains good binding activity.

An ELISA assay to detect direct binding of the aCD3-XTEN-aHER2 to HER2-Fc-coated wells was performed as follows. The extracellular domain of HER2 fused to the Fc domain of human IgG was coated on to the wells of a microtiter plate. A dilution series of the aCD3-XTEN-aHER2 was then applied to the coated wells. After two hours the unbound aCD3-XTEN-aHER2 was washed away and any bound protein detected with an HRP-conjugated anti-HA antibody. The results of the binding assays are shown in FIG. 21A. The control fusion protein with N-terminal aHER2 binds to HER2-Fc with an apparent Kd of 80 µM, while the C-terminal fusion of the aCD3-XTEN-aHER2 binds with an apparent Kd of 3.4 nM. Thus, the anti-Her2 component of the aCD3-XTEN-aHER2 construct still retains good binding affinity, although it is lower than the N-terminal construct.

Figure 21C:
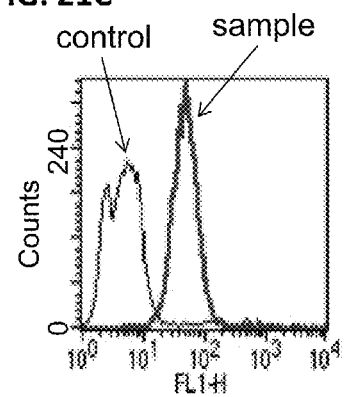
FIG. 21(A-C) shows results from characterization assays of a bispecific scFv binding fusion protein, as described in Example 36.
Figure 22:
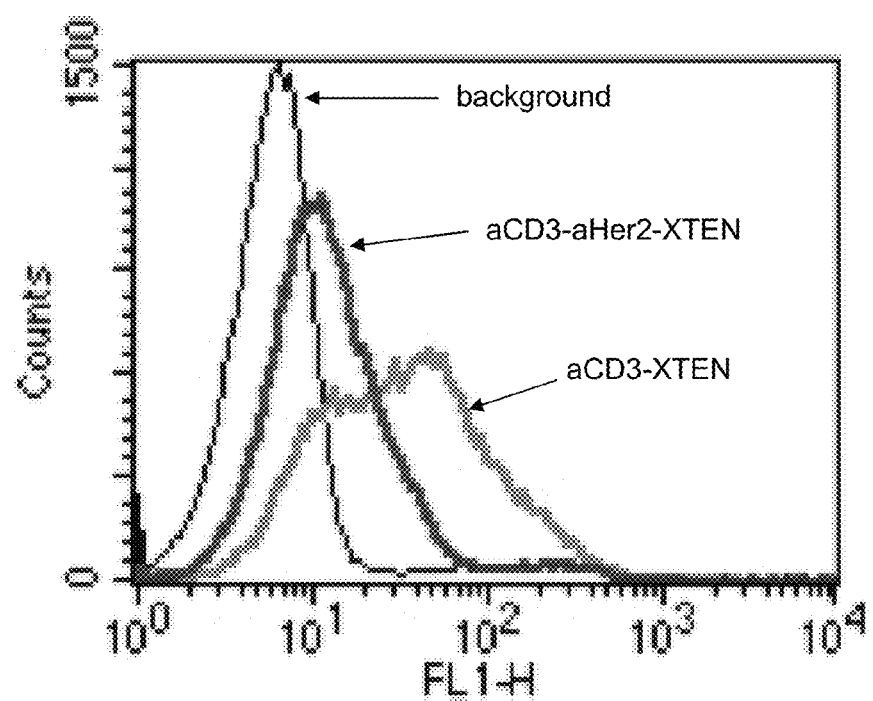
FIG. 22 shows results from a flow cytometry assay to characterize the binding of aCD3-XTEN-GFP to CD3-positive Jurkat cells. The assay was performed using anti-GFP antibody detection of aCD3-XTEN-GFP reacted in the presence of a 10-fold molar excess of aHER2-aCD3-XTEN, as described in Example 36. The results show that excess bispecific aHER2-aCD3-XTEN competitively displaces the monospecific aCD3-XTEN-GFP protein and eliminates the observed MFI shift.

Flow cytometry analysis of E aHER2-XTEN (FIG. 19) and aCD3-XTEN-aHER2 (FIG. 21C) show binding to HER2-expressing SK-BR-3 cells. Detection was via an anti-HA antibody and appropriate secondary antibody. The binding of aCD3-XTEN-GFP to CD3-positive Jurkat cells was measured by flow cytometry, using anti-GFP antibody detection, in the presence of a 10-fold molar excess of aHER2-aCD3-XTEN. The results clearly demonstrate that excess bispecific aCD3-XTEN-aHER2 competitively displaces the monospecific aCD3-XTEN-GFP protein and eliminates the observed MFI shift (FIG. 22). Thus, we have engineered a aCD3-XTEN-aHER2 bispecific binding fusion protein that interacts with HER2-expressing tumor cells and CD3-positive T-cells.

Figure 23:
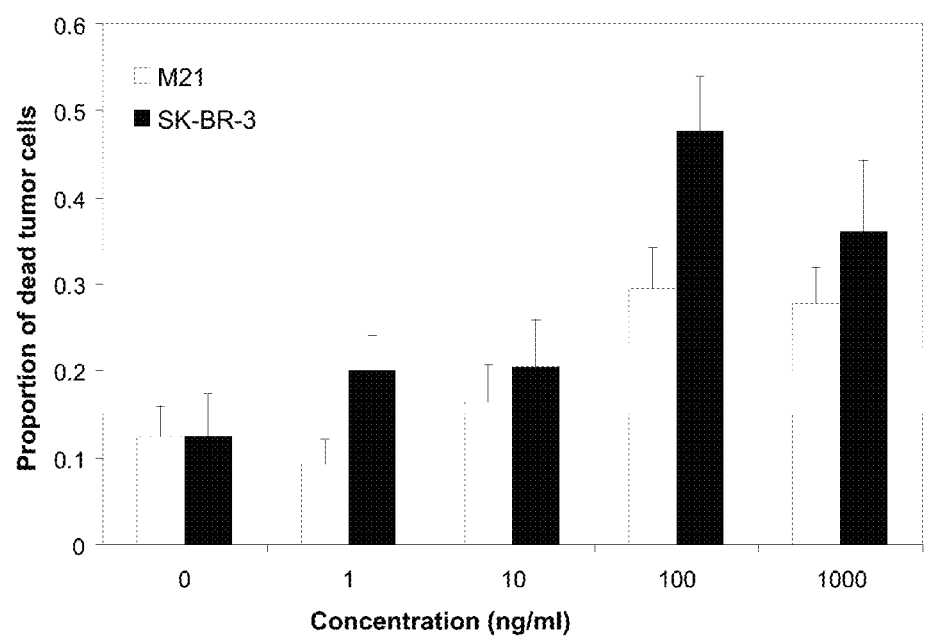
FIG. 23 shows results from a tumor cell killing assay in which varying concentrations of the bispecific aHER2-XTEN-aCD3 were incubated with either M21 or SK-BR-3 target cells for 24 h, as described in Example 36, followed by staining with propidium iodide to measure killing, shown in the bar graph as the proportion of dead tumor cells for the two cell lines.

To demonstrate the ability of the aCD3-XTEN-aHER2 binding fusion protein to target and kill cancer cells, an assay was performed using the construct to direct the cytotoxic activity of T-cells towards tumor cells. Here, we tested the efficacy of the candidate aCD3-XTEN-aHER2 using M21 melanoma and SK-BR-3 breast cancer cells. Tumor cells, expressing the target receptor, were labeled with a membrane permeable fluorophore, $DiOC_{18}$. Fresh peripheral blood mononuclear cells (PBMCs) were then mixed with the labeled tumor cells (Effector cell:Tumor cell ratio 10:1) and the aCD3-XTEN-aHER2 binding fusion protein. After 24 hours the cell suspensions were collected by centrifugation and dead cells were labeled with propidium iodide. The cells were analyzed on a Zeiss Axiovert 100 microscope. Images of target ($DiOC_{18}$) and dead cells (propidium iodide) were captured with a SPOT CCD camera using appropriate excitation and emission filter sets. Image analysis was conducted using the program ImageJ. The number of target cells per image was determined by using the analyze particles command using the green ($DiOC_{18}$) fluorescence channel image. The fraction of these cells that were dead was determined by overlapping the red (propidium iodide) fluorescence channel using the co-localization plugin and counting the number green cells that were also red. The proportion of dead tumor cells, as a function of aHER2-aCD3-XTEN concentration is shown in FIG. 23. A general linear model with a log it link function was fit to the data with concentration of aCD3-XTEN-aHER2 fusion protein as the independent variable. The model found aCD3-XTEN-aHER2 concentration to be a significant predictor of tumor cell death at a p-value of <0.001 for both M21 and SK-BR-3 target cells. The results support the conclusion that binding fusion proteins with targeting moieties directed to tumor associated antigens can have activity against tumor cells.

Example 37

Characterization of aHER2-XTEN-aEGFR

Size exclusion chromatography was performed on recovered aHER2-XTEN-aEGFR to assess its monomeric characteristics. Results from the SEC analysis demonstrate that the aHER2-XTEN-aEGFR (FIG. 17C) did not dimerize or form other higher order oligomers. As shown in FIG. 17C, the apparent molecular weight is approximately five-fold larger than its calculated mass (approximately 107 kDa) or the mass estimated from the SDS PAGE of FIG. 17B, due to the XTEN component; here the elution volume of aHER2-XTEN-aEGFR is compared a set of globular molecular weight standards (from left to right: 670, 158, 44, 17, and 1.4 kDa). The binding activity of aHER2-XTEN-aEGFR to its respective targets was tested in a ELISA format. The extracellular domains of either HER2 or EGFR fused to the Fc domain of human IgG were coated on to the wells of a microtiter plate. A dilution series of the aHER2-XTEN-aEGFR was then applied to the coated wells. After two hours the unbound aHER2-XTEN-aEGFR was washed away and any bound protein detected with an HRP-conjugated Anti-HA antibody. The result indicate that the bifunctional BPXTEN construct was able to bind each target at essentially equivalent concentrations. (FIG. 18).

Example 38

Characterization of Multivalent aEGFR Vhh Binding Fusion Proteins

Figure 24A:
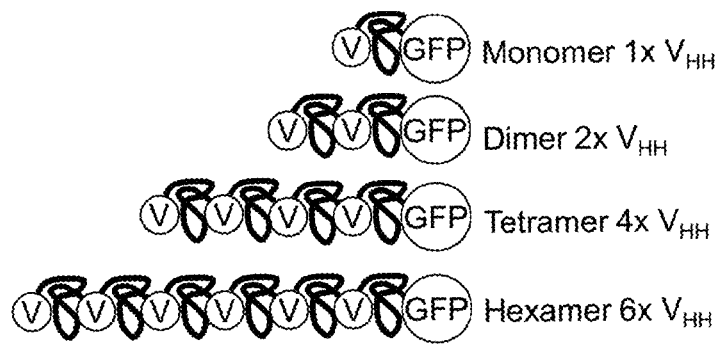
FIG. 24A shows schematic portrayals of monomeric, dimeric, tetrameric, and hexameric anti-EGFR Vhh constructs linked by XTEN, with a C-terminal GFP.
Figure 24B:
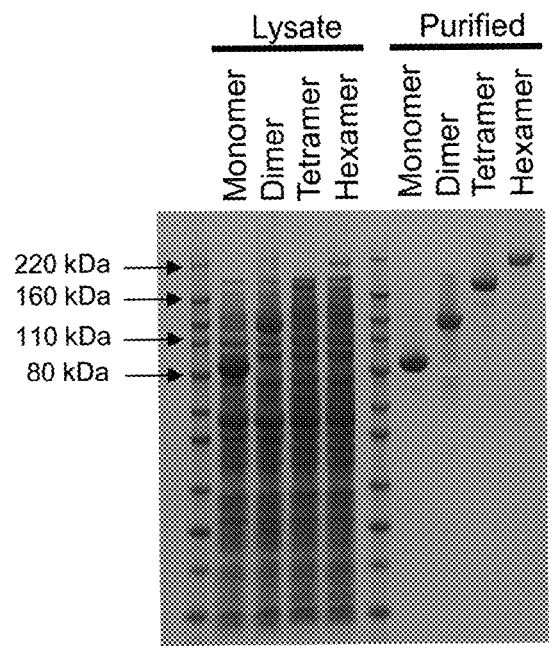
FIG. 24B shows SDS-PAGE of lysate and the purified Vhh constructs, as described in Example 38, demonstrating the purity and the "ladder" increase in molecular weight with increasing units of the anti-EGFR Vhh targeting moiety.
Figure 25:
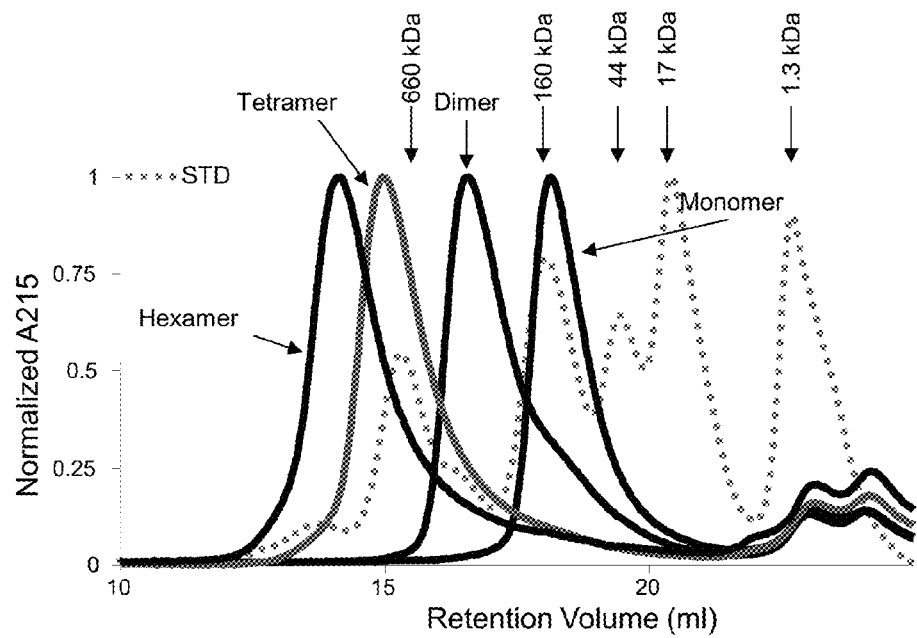
FIG. 25 shows the output of a size exclusion chromatography (SEC) analysis of the monomeric and multivalent anti-EGFR Vhh binding fusion protein constructs of FIG. 24A compared to molecular weight standards, as described in Example 38. The results demonstrate proportional increases approximate apparent molecular weight of the constructs with increasing numbers of Vhh targeting moieties, compared to the molecular weights determined by SDS-PAGE in FIG. 24B and listed in Table 26.

Characterization of domain binding fusion proteins was performed on aEGFR-XTEN Vhh constructs that had increasing numbers of targeting moieties, as depicted schematically in FIG. 24A. SDS-PAGE and SEC were performed with four constructs; LCW501.001, LCW502.009, LCW503.004, and LCW504.004. A clear laddering across constructs in the SDS-PAGE analysis, shown in FIG. 24B, demonstrates the increasing length of the protein as the number of anti-EGFR binding domains increases. This is mirrored by the SEC that, in FIG. 25, shows an increase in the hydrodynamic radius of the proteins as the number of anti-EGFR domains increases. The derived values for apparent molecular weight factor, apparent molecular weight factor and hydrodynamic radii are presented in Table 26. Note that these hydrodynamic radii are characteristically large for a protein of this molecular weight due to the unstructured nature of the XTEN linker domains, resulting in an increased apparent molecular weight for each of the domain binding fusion proteins.

Figure 26A:
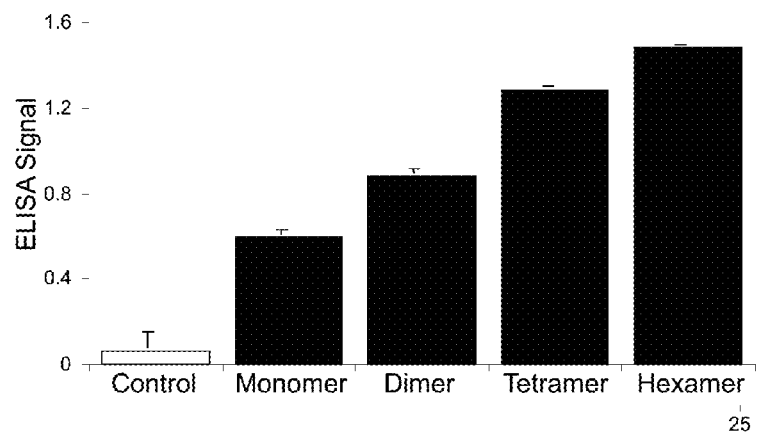
FIG. 26A shows results of the ELISA signal generated using equi-molar concentrations of the various monomeric or multivalent anti-EGFR Vhh binding fusion proteins against the EGFR target.
Figure 26B:
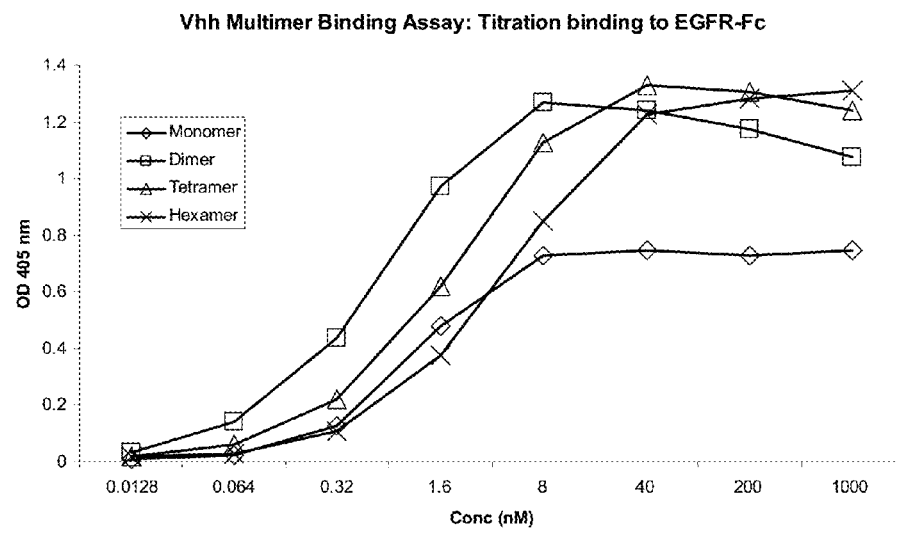
FIG. 26B shows the results of binding curves for the same constructs at various dilutions, with the multivalent forms resulting in more signal than the construct with a single Vhh targeting moiety.

LCW501.001, LCW502.009, LCW503.004, and LCW504.004 were also characterized in two different ELISA experiments. In the first Costar 3690 plates were coated with 100 ng of EGFR-Fc in 50 µl of PBS overnight at 4° C., blocked with 3% BSA in PBS for 1 hour, bound with multivalent aEGFR Vhh binders from 1 µM downward using 5-fold dilutions in binding buffer (1% BSA in PBST) for 2 hours at RT with shaking at 80 rpm, washed three times with PBST, detected with a 1:5000 dilution of goat anti-GFP—HRP for 1 hour at room temperature with shaking at 80 rpm, washed five times with PBST, developed with ABTS-$H_2O_2$ substrate and read at 405 nm. Binding curves were determined for each of the different multimer species. All of the higher order multimers showed tighter binding than the monomer indicating an avidity effect and that multiple binding sites were active in the multivalent molecules (FIG. 26A). The second ELISA based characterization was as follows: Costar 3690 plate were coated with 200 ng of goat anti-GFP in 50 µl of PBS overnight at 4° C., blocked with 3% BSA in PBS for 1 hour, bound with multivalent aEGFR Vhh binders from 3 µM downward using 5-fold dilutions in binding buffer (1% BSA in PBST) for 2 hours at RT with shaking at 80 rpm, washed three times with PBST, detected with 100 ng/well (~20 nM) of biotinylated EGFR-Fc for 1 hour at room temperature with shaking at 80 rpm, washed three times with PBST, amplified with 1:5000 dilution of streptavidin-HRP in binding buffer and developed with ABTS-$H_2O_2$ substrate and read at 405 nm. The higher order multimers showed and increased capacity for EGFR-Fc binding (FIG. 26B) indicating that increasing the number of EGFR binding modules in the protein increases the number of available binding sites within the protein. These data suggest that all of the binding sites in the binding fusion proteins, including the higher order tetramers and hexamers, are active and capable of binding EGFR.

Example 39

Purification of aHER2-XTEN

AC51 was grown to saturation overnight in 2xYT+kanamycin. A 500 mL flask of 2xYT was inoculated with 3 ml of this saturated overnight and grown to an OD600 of ~0.8 at 37° C. The culture was brought to 25° C. and then induced with 0.2 mM IPTG. The culture was induced overnight. The cell pellet was harvested by centrifugation at 5000 rpm, in a Sorvall SLA-3000 at 4° C. The cell pellet was then resuspended in 30 mM Tris pH 8.0, 500 mM NaCl, 20 mM imidazole. The cells were lysed by sonication and then clarified by centrifugation at 15,000 rpm in a Sorvall centrifuge. The supernatant was loaded onto Ni-NTA column, washed with 10 column volumes of 30 mM Tris pH 8.0, 500 mM NaCl, 20 mM imidazole, and eluted with 30 mM Tris pH 8.0, 500 mM NaCl, 600 mM imidazole. This protein was assigned lot # AP44.

Example 40

Analytical Size Exclusion Chromatography of XTEN Fusion Proteins

Size exclusion chromatography analysis was performed on binding fusion proteins containing various targeting moieties and unstructured recombinant proteins of varying length to determine the effect on XTEN on increasing the apparent molecular weight. An exemplary assay used a TSKGel-G4000 SWXL (7.8 mm×30 cm) column in which 40 mg of purified glucagon fusion protein at a concentration of 1 mg/ml was separated at a flow rate of 0.6 ml/min in 20 mM phosphate pH 6.8, 114 mM NaCl. Chromatogram profiles were monitored using OD214 nm and OD280 nm Column calibration for all assays were performed using a size exclusion calibration standard from BioRad; the markers include thyroglobulin (670 kDa), bovine gamma-globulin (158 kDa), chicken ovalbumin (44 kDa), equine myoglobin (17 kDa) and vitamin B12 (1.35 kDa). Representative SEC profiles of binding fusion proteins are shown as overlays in FIGS. 17C, 20 and 25. Based on the SEC analyses for all constructs evaluated, the apparent molecular weight factors, the apparent molecular weight factor (expressed as the ratio of apparent molecular weight factor to the calculated molecular weight) and the hydrodynamic radius ($R_H$ in nm) are shown in Table 26. The data show that the apparent molecular weight of each compound is proportional to the length of the attached XTEN sequence. This is particularly evident in the case of the EGFR Vhh constructs that included increasing units of EGR-F_VHH-AM144_XTEN, going from monomer to dimer to tetramer to hexamer, and showed increases in apparent molecular weight factor as the cumulative length of XTEN increased with each addition of the AM144 linkers. The data also show that the apparent molecular weight of each construct is significantly larger than that expected for a globular protein (as shown by comparison to the standard proteins run in the same assay). Additionally, the incorporation of XTEN fusion partners with 244 total amino acids or more into fusion proteins with targeting moieties resulted with a hydrodynamic radius of 7 nm or greater; well beyond the glomerular pore size of approximately 3-5 nm. Accordingly, it is concluded that binding fusion proteins comprising targeting moieties and XTEN would have reduced renal clearance, contributing to increased terminal half-life and improving the therapeutic or biologic effect relative to a corresponding unfused targeting moiety proteins.

TABLE 26

SEC analysis of various polypeptides

| Construct Name | XTEN or fusion partner | Therapeutic Protein | Actual MW (KDa) | Apparent MW (kDa) | Apparent Molecular Weight Factor | $R_H$ (nm) |
|---|---|---|---|---|---|---|
| XTEN_AE912-aIL6R scFv | AE912 | Anti-IL6R | 111 | 883 | 7.9 | 8.7 |
| aHER2-XTEN Y288-aHER2 | Y288 | Anti-HER2 | 83 | 419 | 5.0 | 7.4 |
| EGFR_Vhh-XTEN monomer | AM144 | Anti-EGFR | 54 | 107 | 2 | 4.9 |
| EGFR_Vhh-XTEN dimer | AM144 X2 | Anti-EGFR | 81 | 329 | 4.1 | 7.0 |
| EGFR_Vhh-XTEN tetramer | AM144 X4 | Anti-EGFR | 135 | 1022 | 7.5 | 9.1 |
| EGFR_Vhh-XTEN hexamer | AM144 X6 | Anti-EGFR | 189 | 1802 | 9.5 | 10.1 |

Example 41

Creation, Purification and Characterization of Binding Fusion Protein-Conjugates-aHer2-XTEN Constructs with Conjugated AF680 Fluorophore To test the feasibility and utility of binding fusion protein-drug conjugates, binding fusion proteins were conjugated with a fluorophore that was then characterized for binding affinity and utilized in preclinical animal models to evaluate the ability of the conjugates to systemically distribute after injection and bind target tumor tissue.

aHer2-XTEN(AE864-Cys)-AF680

The E. coli containing the AC452 gene on a plasmid were grown in liquid culture to saturation overnight and then 90 ml of this culture was used to inoculate 4.5 L pho induction media, divided evenly between 9 4 L flasks. Cultures were grown at 26° C. in the presence of 10 µg/ml tetracycline and were induced as phosphate was depleted from the media. Protein was trafficked to the periplasm of the host cells via an STII signal sequence fused to the N-terminus of the encoded protein that was subsequently removed by post-translational modification in the cells. The cell pellet was harvested by centrifugation for 20 min at 4000 rpm in a SLA-3000 rotor. Some of the cell pellet (45 of 90 total g) was resuspended in 121 ml of PBS plus 10 mM imidizole and 13.5 ml of Bug-Buster and DNase were added. The cells were lysed by vortexing periodically over a 90 minute period. The lysate was then clarified by centrifugation at 15,000 rpm for 30 minutes. The clarified lysate was then loaded on to an 85 ml toyopearl chelate column charged with 100 mM NiSO$_4$, and equilibrated with PBS plus 10 mM imidizole. The column was washed with 5 column volumes of PBS plus 10 mM imidizole, and the protein eluted with 3 column volumes of PBS plus 250 mM imidizole and then stripped with 1.2 column volumes of PBS plus 500 mM imidizole. The eluate was reduced with 0.3 mM TCEP and then labeled for 3 hours at room temperature with Alexa Fluor 680 at a ratio of 0.1 mg of dye per mg of protein. The sample was then transferred to 4° C. for overnight storage. The sample was then diluted 2.7 fold with water to reduce the conductivity and loaded on to a macrocapQ column, previously sanitized with NaOH and equilibrated with 20 mM Tris pH 7.5, 50 mM NaCl. The column was washed with 5 column volumes of 20 mM Tris pH 7.5, 50 mM NaCl and eluted with a 10 column volume linear gradient from 150 mM NaCl to 300 mM NaCl both with 20 mM Tris pH 7.5 as the buffer. The pooled elution fractions were concentrated using an Amicon ultra concentrator with a 10,000 MWCO membrane and stored at −80° C., assigned lot # AP502.

aHer2-XTEN(AE576-Cys)-AF680

The E. coli containing the AC451 gene on a plasmid were grown in liquid culture to saturation overnight and then 90 ml of this culture was used to inoculate 10 L pho induction media, divided evenly between 20 4 L flasks. Cultures were grown at 26° C. in the presence of 10 µg/ml tetracycline and were induced as phosphate was depleted from the media. Protein was trafficked to the periplasm of the host cells via an STII signal sequence fused to the N-terminus of the encoded protein that was subsequently removed by post-translational modification in the cells. The cell pellet was harvested by centrifugation for 20 min at 4000 rpm in a SLA-3000 rotor. The cell pellet (39 g) was resuspended in 96.3 ml of PBS plus 10 mM imidizole and 10.7 ml of BugBuster and DNase were added. The cells were lysed by vortexing periodically over a 55 minute period. The lysate was then clarified by centrifugation at 15,000 rpm for 25 minutes. The clarified lysate was then loaded on to an 85 ml toyopearl chelate column charged with 100 mM NiSO$_4$, and equilibrated with PBS plus 10 mM imidizole. The column was washed with 5 column volumes of PBS plus 10 mM imidizole, and the protein eluted with 3 column volumes of PBS plus 250 mM imidizole and then stripped with 1.2 column volumes of PBS plus 500 mM imidizole. The eluate was reduced with 0.3 mM TCEP and then labeled for 3 hours at room temperature with Alexa Fluor 680 at a ratio of 0.1 mg of dye per mg of protein. The sample was then transferred to 4° C. for overnight storage. The sample was then diluted 2.7 fold with water to reduce the conductivity and loaded on to a macrocapQ column, previously sanitized with NaOH and equilibrated with 20 mM Tris pH 7.5, 50 mM NaCl. The column was washed with 5 column volumes of 20 mM Tris pH 7.5, 50 mM NaCl and eluted with a 10 column volume linear gradient from 150 mM NaCl to 300 mM NaCl both with 20 mM Tris pH 7.5 as the buffer. The pooled elution fractions were concentrated using an Amicon ultra concentrator with a 10,000 MWCO membrane and stored at −80° C., assigned lot # AP486.

aHer2-XTEN(AE288-Cys)-AF680

The *E. coli* containing the AC450 gene on a plasmid were grown in liquid culture to saturation overnight and then 90 ml of this culture was used to inoculate 10 L pho induction media, divided evenly between 20 4 L flasks. Cultures were grown at 26° C. in the presence of 10 μg/ml tetracycline and were induced as phosphate was depleted from the media. Protein was trafficked to the periplasm of the host cells via an STH signal sequence fused to the N-terminus of the encoded protein that was subsequently removed by post-translational modification in the cells. The cell pellet was harvested by centrifugation for 60 min at 4000 rpm in a SLA-3000 rotor. The cell pellet (36 g) was resuspended in 97 ml of PBS plus 10 mM imidizole and 10.7 ml of BugBuster and DNase were added. The cells were lysed by vortexing periodically over a 55 minute period. The lysate was then clarified by centrifugation at 15,000 rpm for 25 minutes. The clarified lysate was then loaded on to an 85 ml toyopearl chelate column charged with 100 mM NiSO4, and equilibrated with PBS plus 10 mM imidizole. The column was washed with 5 column volumes of PBS plus 10 mM imidizole, and the protein eluted with 3 column volumes of PBS plus 250 mM imidizole and then stripped with 1.2 column volumes of PBS plus 500 mM imidizole. The eluate was reduced with 0.3 mM TCEP and then labeled for 3 hours at room temperature with Alexa Fluor 680 at a ratio of 0.1 mg of dye per mg of protein. The sample was then transferred to 4° C. for overnight storage. The sample was then diluted 2.7 fold with water to reduce the conductivity and loaded on to a macrocapQ column, previously sanitized with NaOH and equilibrated with 20 mM Tris pH 7.5, 50 mM NaCl. The column was washed with 5 column volumes of 20 mM Tris pH 7.5, 50 mM NaCl and eluted with a 10 column volume linear gradient from 150 mM NaCl to 300 mM NaCl both with 20 mM Tris pH 7.5 as the buffer. The pooled elution fractions were concentrated using an Amicon ultra concentrator with a 10,000 MWCO membrane and stored at −80° C., assigned lot # AP481.

SEC Analysis of aHer2-XTEN(AE288-Cys)-AF680, aHer2-XTEN(AE576-Cys)-AF680, aHer2-XTEN(AE576-Cys)-AF680

Figure 33:
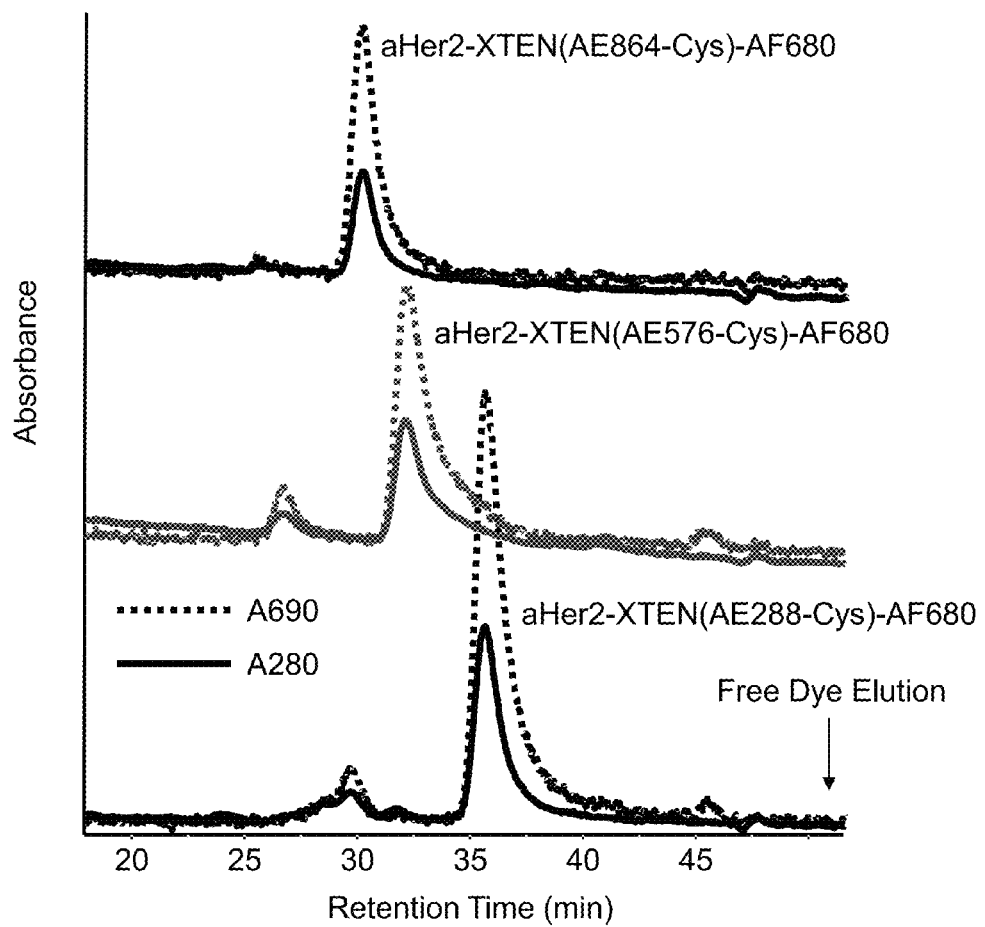
FIG. 33 shows overlays of SEC chromatograms of three aHer2-XTEN(Cys)-AF680 conjugated fusion proteins with three different XTEN; AE864, AE576, and AE288 (top to bottom), performed as described in Example 41. The chromatograms show that the Alexa Fluor 680 was successfully conjugated to the aHer2-XTEN(Cys) protein as the retention time of the absorbance of the Alexa Fluor 680 (A690) overlaps with that of the aHer2-XTEN(Cys) protein (A280) for all three samples, and that the constructs eluted in a proportional fashion relative to length of the XTEN component. Note that dye retention time is significantly shifted from the expected elution time of free dye at ~52 minutes. Additionally, the relative lack of material that elutes ahead of the various aHer2-XTEN(Cys) peaks indicates a lack of aggregation and a monodispersed product.

Confirmation that the Alexa Fluor 680 was conjugated to the XTEN proteins was provided by analytical size exclusion chromatography. The characteristic 690 nm absorbance of the dye would elute very late in the SEC chromatogram if it were free in solution, whereas if it were conjugated to the XTEN protein it would elute earlier at the characteristic volume of the XTEN. The three constructs were assayed using a BioSep S4000 (7.8×6000 mm, phenomenex) run on an Akta purifier system and the chromatogram for each of the three constructs was monitored at 280 (FIG. 33, solid lines) and 690 nm (FIG. 33, dotted lines). For each of the all three constructs, the 690 nm absorbance peaks co-eluted with the 280 nm peak, indicating that the Alex Fluor 680 was conjugated to the XTEN fusion protein. No free dye was noted at the expected elution time of approximately 52 minutes. The chromatograms also reflect elutions proportional to the increase in apparent mass contributed by the length of the respective XTEN components.

Flow Cytometry Analysis of aHer2-XTEN Conjugates

Figure 34A:
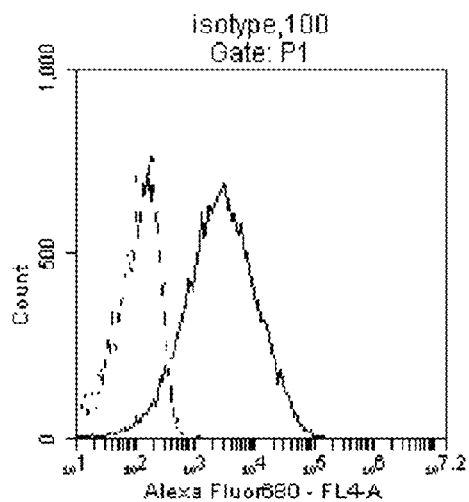
FIG. 34A is the output of the aHer2-XTEN_AE864-AF680 assay.
Figure 34B:
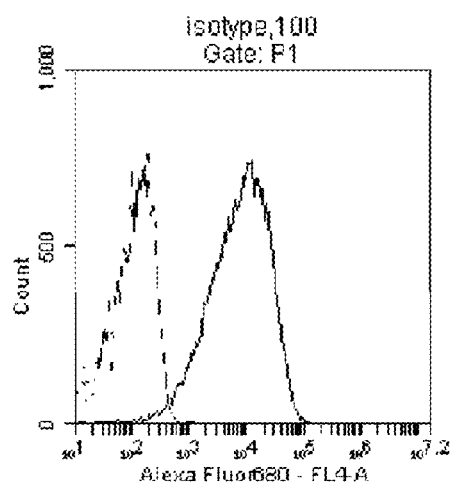
FIG. 34B is the output of the aHer2-XTEN_AE576-AF680 assay.
Figure 34C:
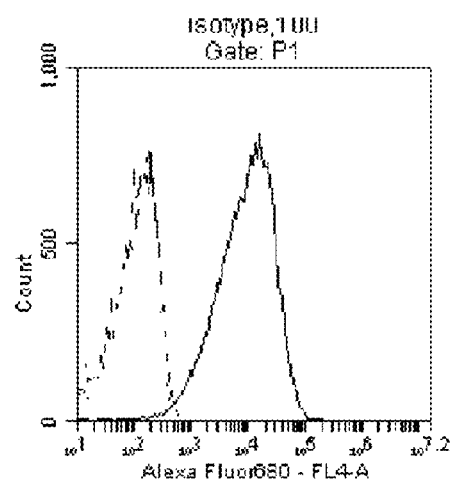
FIG. 34C is the output of the aHer2-XTEN_AE288-AF680 assay.

Specific binding of a binding fusion protein to a tumor cell line was evaluated using the constructs of anti-HER2 targeting moiety linked to different lengths of XTEN, with a fluorophore AF680 covalently linked to XTEN, as described above. The aHer2-XTEN-Cys-AF680 constructs binding to Her2 were assessed by flow cytometry on the Her2+ tumor cell line, SKOV3, as follows: SKOV3 cells were grown from frozen stocks and passaged 2-3 times. Cells were resuspended into 31 tubes and incubated at $1\times10^6$ cells/tube with Fc block (BD BioSciences) for 10 minutes on ice. Fifteen tubes were preincubated with 1000 nM unlabeled Herceptin (to block binding as a control) for 20 minutes on ice. All tubes (15 incubated with unlabeled Herceptin, 15 not incubated with unlabeled Herceptin) were then incubated with the 100 nM of the appropriately labeled aHer2-XTEN-AE-288-Cys-AF680, aHer2-XTEN-AE-576-Cys-AF680, and aHer2-XTEN-AE-864-Cys-AF680 conjugate or the labeled isotype control for 20 minutes on ice, washed twice with flow buffer, the pellets were resuspended in 0.2 mL of flow buffer and then were run on an Accuro C6 Flow Cytometer. Data were collected for forward and side scatter and side scatter vs. FL4 for Alexa680. Data (FIG. 34) are presented as histograms of each aHer2-XTEN-AE-864-Cys-AF680 (FIG. 34A), aHer2-XTEN-AE-576-Cys-AF680 (FIG. 34B), and aHer2-XTEN-AE-288-Cys-AF680 conjugate (FIG. 34C) overlayed with blocked and unblocked Herceptin. The data show that Herceptin completely blocked the binding of the aHer2-XTEN-AE-288-Cys-AF680, aHer2-XTEN-AE-576-Cys-AF680, and aHer2-XTEN-AE-864-Cys-AF680 conjugate to Her2+ SKOV3 cells in vitro, demonstrating the specific binding of the conjugate constructs for the Her2 target on the tumor cells.

In Vivo and Ex Vivo Imaging of aHer2-XTEN Conjugates

Targeting and biodistribution of the aHer2-XTEN-Cys-AF680 constructs, prepared as described above, to Her2+ tumor was assessed using in vivo, followed by ex vivo, fluorescence imaging. Control groups included mice injected with fluorescently tagged Herceptin-Alexa 680 and mice injected with aHer2-XTEN-864-Alexa 680 but blocked with Herceptin one hour prior to injection.

Female nu/nu mice bearing SKOV3 tumor cells were given a single injection of high or low dose aHer2-XTEN-AE-288-Cys-AF680, aHer2-XTEN-AE-576-Cys-AF680, aHer2-XTEN-AE-864-Cys-AF680 or Herceptin-AF680 control. Whole body scans were acquired pre-injection and then at approximately 8, 24, 48 and 72 hours post-injection. Following the 72 hour time point all high dose groups were euthanized and tumors, liver, lung, heart, spleen and kidneys were ex vivo imaged using ex vivo fluorescence imaging. Fluorescence imaging was performed using an IVIS 50 optical imaging system (Caliper Life Sciences, Hopkinton, Mass.). Cy5.5 excitation (615-665 nm) and emission (695-770 nm) filters were selected to match the fluorescence agents' wavelengths. Small and medium binning of the CCD chip was used and the exposure time was between 5-20 seconds to obtain at least several thousand counts from the signals that were observable in each mouse in the image and to avoid saturation of the CCD chip. To normalize images for quantification, a background fluorescence image was acquired using background excitation and emission filters for the Cy5.5 spectral region.

Figure 35:
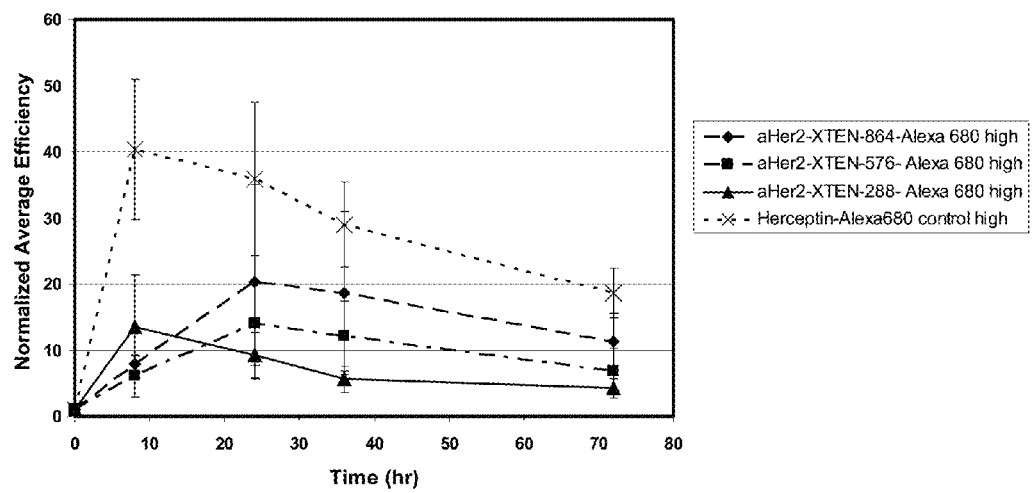
FIG. 35 shows the graphed results of in vivo imaging data from female nu/nu mice bearing SKOV3 tumor cells given a single injection of high or low dose aHer2-XTEN-AE-288-Cys-AF680, aHer2-XTEN-AE-576-Cys-AF680, aHer2-XTEN-AE-864-Cys-AF680 or Herceptin-AF680 control, as described in Example 41.

In vivo imaging data are shown in FIG. 35 and Table 27. Several of the groups showed specific fluorescent signals in the tumor, above the level of the autofluorescent background. Significant signals were evident in most of the higher dosage level (6.7 nmol/mouse) aHer2-XTEN test agent groups (Groups 1, 3 and 5) as well as the positive control group dosed with tagged herceptin (Group 7). In addition, there were minor trends suggesting detection of the agents in the tumors for some of the groups where the lower dosage levels were administered. The data also showed a 50% higher peak value for aHer2-XTEN-864-Alexa 680 (Group 1), compared with aHer2-XTEN-576-Alexa 680 (Group 3) and aHer2-XTEN-288-Alexa 680 (Group 5). While the tagged herceptin showed peak tumor binding 8 h post-administration, the test agents generally showed later peak binding approximately 24-48 h post-administration. aHer2-XTEN-288-Alexa 680 showed the most rapid targeting kinetics, as well as the most rapid clearance.

Figure 36:
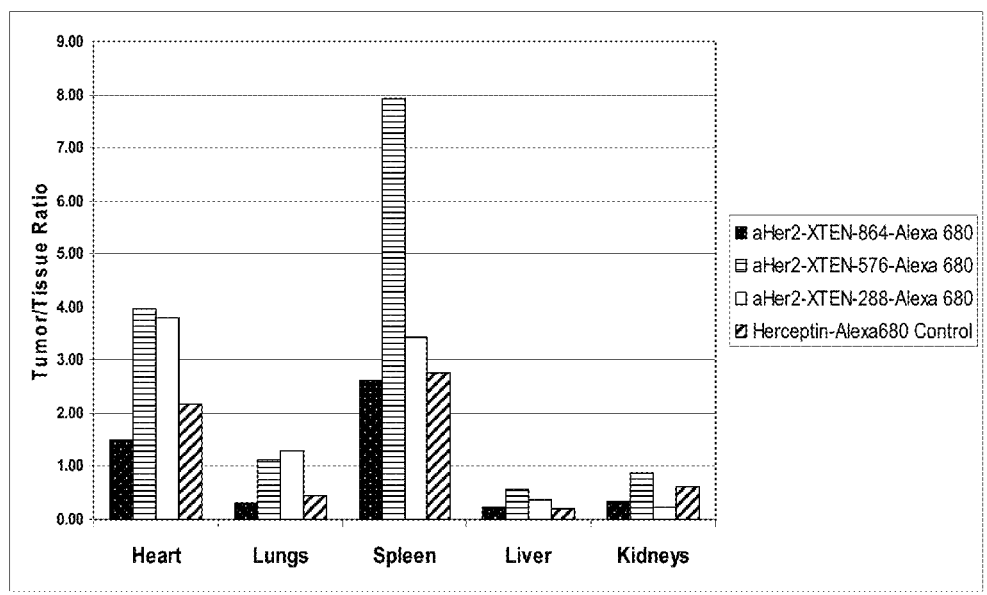
FIG. 36 shows the graphed results of ex vivo imaging data from the same treatment groups as per FIG. 36, demonstrating that all aHer2-XTEN binding fusion protein constructs had penetration into the assayed tissues, with the longer AE864 XTEN construct demonstrating the highest levels compared to the other two, as described in Example 41.

Ex vivo imaging data shown in FIG. 36 and Table 28 summarizes the mean total fluorescence signals measured by group and tissue type. Imaging of tumors in Groups 2 and 9 demonstrated approximately 6-fold higher total fluorescence signal in Group 2 (0.67 nmol aHer2-XTEN-864-Alexa 680) compared with Group 9 (0.67 nmol aHer2-XTEN-864-Alexa 680+100× excess unlabeled Herceptin administered 1 hour prior) indicating specific Her2+ tumor targeting. Results from the extended tissue set (tumor, heart, lungs, spleen, liver, kidneys) indicated that Group 7 (3.3 nmol Herceptin-Alexa680) showed the greatest signals in most tissues, but that Group 1 (6.7 nmol aHer2-XTEN-864-Alexa 680), with the longest XTEN molecule, showed nearly comparable total signals in most cases except for the liver, in which the Herceptin Group 7 had approximately double the fluorescent signal compared to the aHer2-XTEN-864 Group 1. Group 3 (6.7 nmol aHer2-XTEN-576-Alexa 680) and Group 5 (6.7 nmol aHer2-XTEN-864-Alexa 680) showed lower signals in all tissues than Groups 1 and 7.

TABLE 27

In vivo fluorescence by group of mean peak signals and signal at 72 h

| Group # | Test Material | Dosage Level (nmol/mouse) | Average Fluorescence Efficiency (group mean normalized to pre-treatment values) | | |
|---|---|---|---|---|---|
| | | | Peak | Peak Time | Level at 72 h |
| Group 1 | aHer2-XTEN-864-Alexa 680 | 6.7 | 20.3 | 24 h | 11.2 |
| Group 2 | aHer2-XTEN-864-Alexa 680 | 0.67 | 5.3 | 48 h | 3.5 |
| Group 3 | aHer2-XTEN-576-Alexa 680 | 6.7 | 14.0 | 24 h | 6.9 |
| Group 4 | aHer2-XTEN-576-Alexa 680 | 0.67 | 3.6 | 48 h | 3.4 |
| Group 5 | aHer2-XTEN-288-Alexa 680 | 6.7 | 13.4 | 8 h | 4.2 |
| Group 6 | aHer2-XTEN-288-Alexa 680 | 0.67 | 3.5 | 48 h | 3.1 |
| Group 7 | Herceptin-Alexa680 Control | 3.3 | 40.3 | 8 h | 18.6 |
| Group 8 | Herceptin-Alexa680 Control | 0.33 | 5.3 | 48 h | 4.4 |
| Group 9 | aHer2-XTEN-864-Alexa 680 + unlabeled Herceptin | 0.67 + 100x excess 1 h before | 6.0 | 72 h | 6.0 |

TABLE 28

Summary by group of mean total signals in tissues imaged ex vivo.

| Group # | Test Material | Dosage Level (nmol/mouse) | Total Fluorescence Efficiency (group mean) (×10$^6$) | | | | | |
|---|---|---|---|---|---|---|---|---|
| | | | Tumor | Heart | Lungs | Spleen | Liver | Kidneys |
| Group 1 | aHer2-XTEN-864-Alexa 680 | 6.7 | 42 | 28 | 130 | 16 | 180 | 120 |
| Group 2 | aHer2-XTEN-864-Alexa 680 | 0.67 | 4.2 | — | — | — | — | — |
| Group 3 | aHer2-XTEN-576-Alexa 680 | 6.7 | 27 | 6.8 | 24 | 3.4 | 48 | 31 |
| Group 5 | aHer2-XTEN-288-Alexa 680 | 6.7 | 7.2 | 1.9 | 5.6 | 2.1 | 20 | 34 |
| Group 7 | Herceptin-Alexa680 Control | 3.3 | 69 | 32 | 150 | 25 | 370 | 110 |
| Group 9 | aHer2-XTEN-864-Alexa 680 + unlabeled Herceptin | 0.67 + 100x excess 1 h before | 0.7 | — | — | — | — | — |

Example 42

Pharmacokinetic Analysis of CTLA4-XTEN

The in vivo pharmacokinetics of CTLA4-XTEN constructs can be assessed using standard methods for protein compositions. Pharmacokinetics is assessed in multiple species, however mice, rats, cynomolgus monkeys, and dogs are preferred due to their common usage in predicting human pharmacokinetics. Compositions of CTLA4-XTEN constructs, or CTLA4 as a comparator, are typically provided in an aqueous buffer compatible with in vivo administration (for example: phosphate-buffered saline or Tris-buffered saline). The compositions would be administered at appropriate doses and via multiple routes: most preferably via intravenous or subcutaneous routes. Blood samples would collected at appropriate time points ranging from 0.08 to 504 hours, and processed into plasma. Plasma samples can be analyzed for concentration of test articles by ELISA assay. Analysis is typically performed using a sandwich ELISA format. Rabbit polyclonal anti-XTEN antibodies or anti-targeting moiety are coated onto wells of an ELISA plate. The wells are blocked, washed and plasma samples are then incubated in the wells at varying dilutions to allow capture of the compound by the coated antibodies. Wells are then washed extensively, and bound protein detected using a biotinylated preparation of a polyclonal anti CTLA4 antibody or anti-XTEN antibody and streptavidin HRP. Concentrations of test article are then calculated at each time point by comparing the colorimetric response at each serum dilution to a standard curve. Pharmacokinetic parameters are then calculated using the WinNonLin software package. It is expected that the results would support the finding that addition of an XTEN to CTLA4 can greatly increase the terminal half-life compared to the targeting moiety not linked to XTEN, and enhance other pharmacokinetic properties as well.

Example 43

Pharmacokinetic Analysis of IL6R-XTEN

The in vivo pharmacokinetics of IL6R-XTEN constructs can be assessed using standard methods for protein compositions. Pharmacokinetics is assessed in multiple species, however mice, rats, cynomolgus monkeys, and dogs are preferred due to their common usage in predicting human pharmacokinetics. Compositions of IL6R-XTEN constructs, or IL6R as comparator, are typically provided in an aqueous buffer compatible with in vivo administration (for example: phosphate-buffered saline or Tris-buffered saline). The compositions would be administered at appropriate doses and via multiple routes: most preferably via intravenous or subcutaneous routes. Blood samples would be collected at appropriate time points ranging from 0.08 to 504 hours, and processed into plasma. Plasma samples are analyzed for concentration of test articles by ELISA assay. Analysis is typically performed using a sandwich ELISA format. Rabbit polyclonal anti-XTEN antibodies or antibodies to the targeting moiety are coated onto wells of an ELISA plate. The wells are blocked, washed and plasma samples are then incubated in the wells at varying dilutions to allow capture of the compound by the coated antibodies. Wells are then washed extensively, and bound protein detected using a biotinylated preparation of a polyclonal anti-IL6R antibody or anti-XTEN antibody and streptavidin HRP. Concentrations of test article are then calculated at each time point by comparing the colorimetric response at each serum dilution to a standard curve. Pharmacokinetic parameters are then calculated using the WinNonLin software package. It is expected that the results would support the finding that addition of an XTEN to IL6R can greatly increase the terminal half-life compared to the targeting moiety not linked to XTEN, and enhance other pharmacokinetic parameters, as well.

Example 44

Pharmacokinetic Analysis of CD40-XTEN

The in vivo pharmacokinetics of CD40-XTEN constructs can be assessed using standard methods for protein compositions. Pharmacokinetics is assessed in multiple species, however mice, rats, cynomolgus monkeys, and dogs are preferred due to their common usage in predicting human pharmacokinetics. Compositions of CD40-XTEN constructs, or CD40 as comparator, are typically provided in an aqueous buffer compatible with in vivo administration (for example: phosphate-buffered saline or Tris-buffered saline). The compositions would be administered at appropriate doses and via multiple routes: most preferably via intravenous or subcutaneous routes. Blood samples would be collected at appropriate time points ranging from 0.08 to 504 hours, and processed into plasma. Plasma samples are analyzed for concentration of test articles by ELISA assay. Analysis is typically performed using a sandwich ELISA format. Rabbit polyclonal anti-XTEN antibodies or antibodies to targeting moiety are coated onto wells of an ELISA plate. The wells are blocked, washed and plasma samples are then incubated in the wells at varying dilutions to allow capture of the compound by the coated antibodies. Wells are then washed extensively, and bound protein detected using a biotinylated preparation of a polyclonal anti CD40 antibody or anti-XTEN antibody and streptavidin HRP. Concentrations of test article are then calculated at each time point by comparing the colorimetric response at each serum dilution to a standard curve. Pharmacokinetic parameters are then calculated using the WinNonLin software package. It is expected that the results would support the finding that addition of an XTEN to CD40 can greatly increase the terminal half-life compared to the targeting moiety not linked to XTEN, and enhance other pharmacokinetic parameters, as well.

Example 45

Preclinical Analysis of CTLA4-XTEN

CTLA4 is involved in delivery of the second co-stimulatory signal required for optimal activation of T cells. As such, the in vivo pharmacologic activity of CTLA4-XTEN constructs can be assessed using preclinical models of human autoimmune inflammatory diseases. Appropriate models for preclinical efficacy testing include but are not limited to collagen induced arthritis, a model for human rheumatoid arthritis, systemic lupus erythematosus, a model for human lupus, and experimental allergic encephalomyelitis, a model for human multiple sclerosis. Preclinical efficacy testing can also be done in transplantation models such as solid organ allograft or islet transplant. These models can be developed in multiple species using methods equivalent to those used for abatacept. CTLA4-XTEN compositions are provided in an aqueous buffer compatible with in vivo administration (for example: phosphate-buffered saline or Tris-buffered saline). The compositions would be administered at appropriate doses, dosing frequency, dosing schedule and route of administration as optimized for the particular model. Efficacy readouts for inflammation could include joint measurements, inhibition of primary and secondary humoral immune response, infiltration of immune cells as measured by histopathology, proteinuria among others. It is expected that the results would support the finding that the CTLA4-XTEN constructs may be more efficacious at inhibiting the inflammatory response as compared to CTLA4 and/or equivalent in potency to comparable dosage CTLA4 with less frequent or more convenient dosing.

Example 46

Preclinical Analysis of Anti-IL6R-XTEN

IL6 plays an important role in the pathogenesis of rheumatoid arthritis. Anti-IL6R inhibits binding of IL6 to its receptor and neutralizes the actions of IL6. As such, the in vivo pharmacologic activity of anti-IL6R-XTEN constructs can be assessed using preclinical models of human autoimmune inflammatory diseases, in particular, rheumatoid arthritis. Appropriate models for preclinical efficacy testing include but are not limited to non human primate collagen induced arthritis, a model for human rheumatoid arthritis. These models can be developed using methods equivalent to those used for tocilizumab. Anti-IL6R-XTEN compositions are provided in an aqueous buffer compatible with in vivo administration (for example: phosphate-buffered saline or Tris-buffered saline). The compositions would be administered at appropriate doses, dosing frequency, dosing schedule and route of administration as optimized for the particular model. Efficacy readouts for inflammation could include joint measurements, swelling, inhibition of primary and secondary humoral immune response, infiltration of immune cells as measured by histopathology, blood chemistry, among others. It is expected that the results would support the finding that the anti-IL6R4-XTEN constructs may be more efficacious at inhibiting the inflammatory response as compared to anti-IL6R and/or equivalent in potency to comparable dosage anti-IL6R with less frequent or more convenient dosing.

Example 47

Preclinical Analysis of Anti-CD40-XTEN

Dysregulation of the CD40-CD40L costimulation pathway plays an important role in the pathogenesis of human inflammatory and autoimmune disease. As such, the in vivo pharmacologic activity of anti-CD40-XTEN constructs can be assessed using preclinical models of human autoimmune inflammatory diseases. Appropriate models for preclinical efficacy testing include but are not limited to collagen induced arthritis, a model for human rheumatoid arthritis, systemic lupus erythematosus, a model for human lupus, and experimental allergic encephalomyelitis, a model for human multiple sclerosis. Preclinical efficacy testing can also be done in transplantation models such as solid organ allograft or islet transplant. These models can be developed using methods equivalent to those used for other CD40 or CD40L targeting therapies. Anti-CD40-XTEN compositions can be provided in an aqueous buffer compatible with in vivo administration (for example: phosphate-buffered saline or Tris-buffered saline). The compositions can be administered at appropriate doses, dosing frequency, dosing schedule and route of administration as optimized for the particular model. Efficacy readouts for inflammation could include joint measurements, inhibition of primary and secondary humoral immune response, infiltration of immune cells as measured by histopathology, proteinuria among others. It is expected that the results would support the finding that the anti-CD40-XTEN constructs may be more efficacious at inhibiting the inflammatory response as compared to anti-CD40 and/or equivalent in potency to comparable dosage anti-CD40 with less frequent or more convenient dosing.

Example 48

Clinical Applications of CTLA4-XTEN

CTLA4 is involved in delivery of the second co-stimulatory signal required for optimal activation of T cells. CTLA4-XTEN can be used to treat T cell mediated autoimmune diseases such as rheumatoid arthritis and psoriasis in clinical trials using similar methodology to Orencia. Fusion of XTEN to CTLA4 to create a binding fusion protein composition is expected to improve the half-life of the recombinant protein, thus enabling a lower overall dose per patient with subsequent improvements in convenience (allowing for subcutaneous dosing, reducing dosing frequency, etc) and cost (reduced drug required per dose).

Clinical trials could be conducted in patients suffering from rheumatoid arthritis. Clinical trials can be designed such that the efficacy and advantages of the CTLA4-XTEN compositions can be verified in humans. Such studies in patients would comprise three phases. First, a Phase I safety and pharmacokinetics study in adult patients would be conducted to determine the maximum tolerated dose and pharmacokinetics and pharmacodynamics in humans. These initial studies could be performed in patients with rheumatoid arthritis and would define potential toxicities and adverse events to be tracked in future studies. The scheme of the study would be to use single escalating doses of CTLA4-XTEN compositions and measure the biochemical, PK, and clinical parameters. This would permit the determination of the maximum tolerated dose and establish the threshold and maximum concentrations in dosage and circulating drug that constitute the therapeutic window to be used in subsequent Phase II and Phase III trials conducted in target indications to determine efficacy and tolerability of the CTLA4-XTEN compositions.

A phase II clinical study of human patients would be conducted in arthritis patients administered CTLA4-XTEN or a suitable anti-inflammatory protein to determine an appropriate dose to relieve at least one symptom associated with rheumatoid arthritis, including reducing joint swelling, joint tenderness, inflammation, morning stiffness, and pain, or at least one biological surrogate marker associated with rheumatoid arthritis, including reducing erythrocyte sedimentation rates, and serum levels of C-reactive protein and/or IL2 receptor. In addition, safety data related to adverse events would be collected. A phase III efficacy study would be conducted wherein arthritis patients would be administered either the CTLA4-XTEN, a positive control, or a placebo daily, bi-weekly, or weekly (or other dosing schedule deemed appropriate given the pharmacokinetic and pharmacodynamic properties of the compound) for an extended period of time. Patients would be evaluated for baseline symptoms of disease activity prior to receiving any treatments, including joint swelling, joint tenderness, inflammation, morning stiffness, disease activity evaluated by patient and physician as well as disability evaluated by, for example, a standardized Health Questionnaire Assessment (HAQ), and pain. Additional baseline evaluations could include erythrocyte sedimentation rates (ESR), serum levels of C-reactive protein (CRP) and soluble IL-2 receptor (IL-2r). The clinical response to treatment could be assessed using the criteria established by the American College of Rheumatology (ACR), such as the ACR20 criterion; i.e., if there was a 20 percent improvement in tender and swollen joint counts and 20 percent improvement in three of the five remaining symptoms measured, such as patient and physician global disease changes, pain, disability, and an acute phase reactant (Felson, D. T., et al., 1993 Arthritis and Rheumatism 36:729-740; Felson, D. T., et al., 1995 Arthritis and Rheumatism 38:1-9). Similarly, a subject would satisfy the ACR50 or ACR70 criterion if there was a 50 or 70 percent improvement, respectively, in tender and swollen joint counts and 50 or 70 percent improvement, respectively, in three of the five remaining symptoms measured, such as patient and physician global disease changes, pain, physical disability, and an acute phase reactant such as CRP or ESR. In addition, potential biomarkers of disease activity could be measured, including rheumatoid factor, CRP, ESR, soluble IL-2R, soluble ICAM-1, soluble E-selectin, and MMP-3. Efficacy outcomes would be determined using standard statistical methods. Toxicity and adverse event markers would also be followed in this study to verify that the compound is safe when used in the manner described.

Example 49

Clinical Applications of IL6R-XTEN

IL6 plays an important role in the pathogenesis of rheumatoid arthritis. Anti-IL6R inhibits binding of IL6 to its receptor and neutralizes the actions of IL6. Anti-IL6R-XTEN can be used to treat T cell mediated autoimmune diseases such as rheumatoid arthritis in clinical trials using similar methodology to Actemra. Fusion of XTEN to anti-IL6R to create a binding fusion protein is expected to improve the half-life of the recombinant protein, thus enabling a lower overall dose per patient with subsequent improvements in convenience (allowing for subcutaneous dosing, reducing dosing frequency, etc) and cost (reduced drug required per dose). Anti-IL6R-XTEN may also provide a safety advantage over the existing anti-IL6R therapy.

Clinical trials could be conducted in patients suffering from rheumatoid arthritis. Clinical trials can be designed such that the efficacy and advantages of the anti-IL6R-XTEN compositions can be verified in humans. Such studies in patients would comprise three phases. First, a Phase I safety and pharmacokinetics study in adult patients would be conducted to determine the maximum tolerated dose and pharmacokinetics and pharmacodynamics in humans. These initial studies could be performed in patients with rheumatoid arthritis and would define potential toxicities and adverse events to be tracked in future studies. The scheme of the study would be to use single escalating doses of anti-IL6R-XTEN compositions and measure the biochemical, PK, and clinical parameters. This would permit the determination of the maximum tolerated dose and establish the threshold and maximum concentrations in dosage and circulating drug that constitute the therapeutic window to be used in subsequent Phase II and Phase III trials conducted in target indications to determine efficacy and tolerability of the anti-IL6R-XTEN compositions.

A phase II clinical study of human patients would be conducted in arthritis patients administered anti-IL6R-XTEN or a suitable anti-inflammatory protein to determine an appropriate dose to relieve at least one symptom associated with rheumatoid arthritis, including reducing joint swelling, joint tenderness, inflammation, morning stiffness, and pain, or at least one biological surrogate marker associated with rheumatoid arthritis, including reducing erythrocyte sedimentation rates, and serum levels of C-reactive protein and/or IL2 receptor. In addition, safety data related to adverse events would be collected. A phase III efficacy study would be conducted wherein arthritis patients would be administered either the anti-IL6R-XTEN, a positive control, or a placebo daily, bi-weekly, or weekly (or other dosing schedule deemed appropriate given the pharmacokinetic and pharmacodynamic properties of the compound) for an extended period of time. Patients would be evaluated for baseline symptoms of disease activity prior to receiving any treatments, including joint swelling, joint tenderness, inflammation, morning stiffness, disease activity evaluated by patient and physician as well as disability evaluated by, for example, a standardized Health Questionnaire Assessment (HAQ), and pain. Additional baseline evaluations could include erythrocyte sedimentation rates (ESR), serum levels of C-reactive protein (CRP) and soluble IL-2 receptor (IL-2r). The clinical response to treatment could be assessed using the criteria established by the American College of Rheumatology (ACR), such as the ACR20 criterion; i.e., if there was a 20 percent improvement in tender and swollen joint counts and 20 percent improvement in three of the five remaining symptoms measured, such as patient and physician global disease changes, pain, disability, and an acute phase reactant (Felson, D. T., et al., 1993 Arthritis and Rheumatism 36:729-740; Felson, D. T., et al., 1995 Arthritis and Rheumatism 38:1-9). Similarly, a subject would satisfy the ACR50 or ACR70 criterion if there was a 50 or 70 percent improvement, respectively, in tender and swollen joint counts and 50 or 70 percent improvement, respectively, in three of the five remaining symptoms measured, such as patient and physician global disease changes, pain, physical disability, and an acute phase reactant such as CRP or ESR. In addition, potential biomarkers of disease activity could be measured, including rheumatoid factor, CRP, ESR, soluble IL-2R, soluble ICAM-1, soluble E-selectin, and MMP-3. Efficacy outcomes would be determined using standard statistical methods. Toxicity and adverse event markers would also be followed in this study to verify that the compound is safe when used in the manner described.

Example 50

Clinical Applications of Anti-CD40-XTEN

Dysregulation of the CD40-CD40L costimulation pathway plays an important role in the pathogenesis of human inflammatory and autoimmune disease. CD40 is over-expressed on antigen presenting cells in a variety of autoimmune conditions including rheumatoid arthritis, psoriasis, inflammatory bowel disease, and type 1 diabetes, and its ligand, CD154, is over-expressed on T cells in many of these same autoimmune diseases. A binding fusion protein of anti-CD40-XTEN could be used to evaluate efficacy in autoimmune inflammatory diseases and its ability to induce transplantation tolerance in clinical trials using similar methodology to the anti-CD40 antibodies currently in clinical trials. Fusion of XTEN to anti-CD40 to create a binding fusion protein is expected to improve the half-life of the recombinant protein, thus enabling a lower overall dose per patient with subsequent improvements in convenience (reduced dosing frequency, etc) and cost (reduced drug required per dose).

Clinical trials could be conducted in patients suffering from any a variety of inflammatory and autoimmune conditions such as but not limited to rheumatoid arthritis, lupus erythematosus, psoriasis, inflammatory bowel disease, multiple sclerosis, etc. or for transplantation. Clinical trials can be designed such that the efficacy and advantages of the anti-CD40-XTEN compositions can be verified in humans. Such studies in patients would comprise three phases. First, a Phase I safety and pharmacokinetics study in adult patients would be conducted to determine the maximum tolerated dose and pharmacokinetics and pharmacodynamics in humans. These studies would define potential toxicities and adverse events to be tracked in future studies. The scheme of the study would be to use single escalating doses of anti-CD40-XTEN compositions and measure the biochemical, PK, and clinical parameters. This would permit the determination of the maximum tolerated dose and establish the threshold and maximum concentrations in dosage and circulating drug that constitute the therapeutic window to be used in subsequent Phase II and Phase III trials conducted in target indications to determine efficacy and tolerability of the anti-CD40-XTEN compositions.

A phase II clinical study of human patients would be conducted in arthritis patients administered anti-CD40-XTEN or a suitable anti-inflammatory protein to determine an appropriate dose to relieve at least one symptom associated with rheumatoid arthritis, including reducing joint swelling, joint tenderness, inflammation, morning stiffness, and pain, or at least one biological surrogate marker associated with rheumatoid arthritis, including reducing erythrocyte sedimentation rates, and serum levels of C-reactive protein and/or IL2 receptor. In addition, safety data related to adverse events would be collected. A phase III efficacy study would be conducted wherein arthritis patients would be administered either the anti-CD40-XTEN, a positive control, or a placebo daily, bi-weekly, or weekly (or other dosing schedule deemed appropriate given the pharmacokinetic and pharmacodynamic properties of the compound) for an extended period of time. Patients would be evaluated for baseline symptoms of disease activity prior to receiving any treatments, including joint swelling, joint tenderness, inflammation, morning stiffness, disease activity evaluated by patient and physician as well as disability evaluated by, for example, a standardized Health Questionnaire Assessment (HAQ), and pain. Additional baseline evaluations could include erythrocyte sedimentation rates (ESR), serum levels of C-reactive protein (CRP) and soluble IL-2 receptor (IL-2r). The clinical response to treatment could be assessed using the criteria established by the American College of Rheumatology (ACR), such as the ACR20 criterion; i.e., if there was a 20 percent improvement in tender and swollen joint counts and 20 percent improvement in three of the five remaining symptoms measured, such as patient and physician global disease changes, pain, disability, and an acute phase reactant (Felson, D. T., et al., 1993 Arthritis and Rheumatism 36:729-740; Felson, D. T., et al., 1995 Arthritis and Rheumatism 38:1-9). Similarly, a subject would satisfy the ACR50 or ACR70 criterion if there was a 50 or 70 percent improvement, respectively, in tender and swollen joint counts and 50 or 70 percent improvement, respectively, in three of the five remaining symptoms measured, such as patient and physician global disease changes, pain, physical disability, and an acute phase reactant such as CRP or ESR. In addition, potential biomarkers of disease activity could be measured, including rheumatoid factor, CRP, ESR, soluble IL-2R, soluble ICAM-1, soluble E-selectin, and MMP-3. Efficacy outcomes would be determined using standard statistical methods. Toxicity and adverse event markers would also be followed in this study to verify that the compound is safe when used in the manner described.

Example 51

Clinical Applications of aHER2-XTEN-aCD3

Her2 antigen is over-expressed on a large number of solid malignancies. Expression is particularly high on many breast cancer cells. Herceptin has been approved for the treatment of HER2-positive breast cancers. A binding fusion protein of anti-Her2-XTEN-anti-CD3 could be evaluated for efficacy in the treatment of the same patient population. Clinical trials can be designed such that the efficacy and advantages of the aHER2-XTEN-aCD3 compositions can be verified in humans. Such studies in patients would comprise three phases. First, a Phase I safety and pharmacokinetics study in adult patients would be conducted to determine the maximum tolerated dose and pharmacokinetics and pharmacodynamics in humans. These studies would define potential toxicities and adverse events to be tracked in future studies. The scheme of the study would be to use single escalating doses of aHER2-XTEN-aCD3 compositions and measure the biochemical, PK, and clinical parameters. This would permit the determination of the maximum tolerated dose and establish the threshold and maximum concentrations in dosage and circulating drug that constitute the therapeutic window to be used in subsequent Phase II and Phase III trials conducted in target indications to determine efficacy and tolerability of the aHER2-XTEN-aCD3 compositions.

Example 52

Characterization of Secondary Structure of Fusion Protein Comprising XTEN

Figure 30:
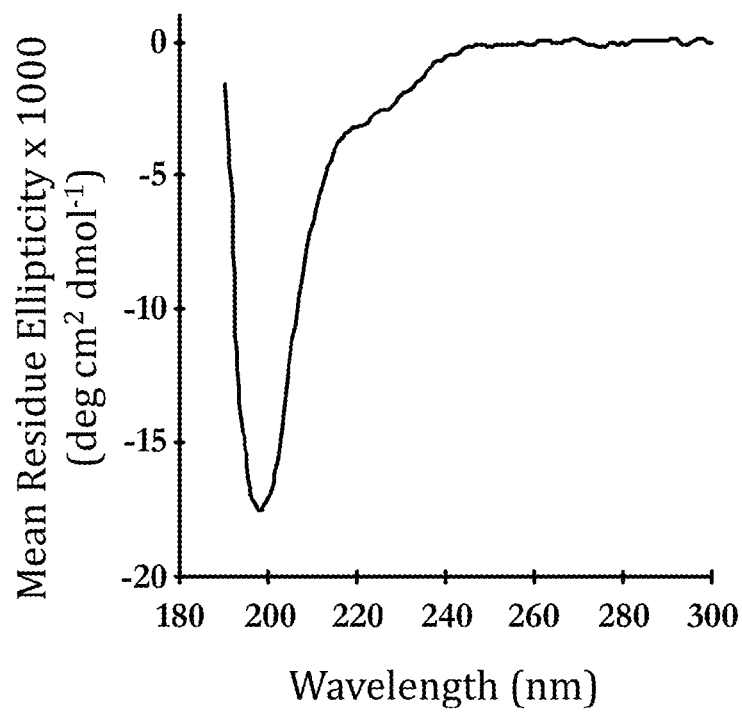
FIG. 30 shows the near UV circular dichroism spectrum of Ex4-XTEN_AE864, performed as described in Example 52.

A fusion protein consisting of the XTEN_AE864 linked to a payload of exenatide was evaluated for degree of secondary structure by circular dichroism spectroscopy. CD spectroscopy was performed on a Jasco J-715 (Jasco Corporation, Tokyo, Japan) spectropolarimeter equipped with Jasco Peltier temperature controller (TPC-348WI). The concentration of protein was adjusted to 0.2 mg/mL in 20 mM sodium phosphate pH 7.0, 50 mM NaCl. The experiments were carried out using HELLMA quartz cells with an optical path-length of 0.1 cm. The CD spectra were acquired at 5°, 25°, 45°, and 65° C. and processed using the J-700 version 1.08.01 (Build 1) Jasco software for Windows. The samples were equilibrated at each temperature for 5 min before performing CD measurements. All spectra were recorded in duplicate from 300 nm to 185 nm using a bandwidth of 1 nm and a time constant of 2 sec, at a scan speed of 100 nm/min. The CD spectrum shown in FIG. 30 shows no evidence of stable secondary structure and is consistent with an unstructured polypeptide.

Example 53

Pharmacokinetics of Extended Polypeptides Fused to GFP in Cynomolgus Monkeys

Figure 31:
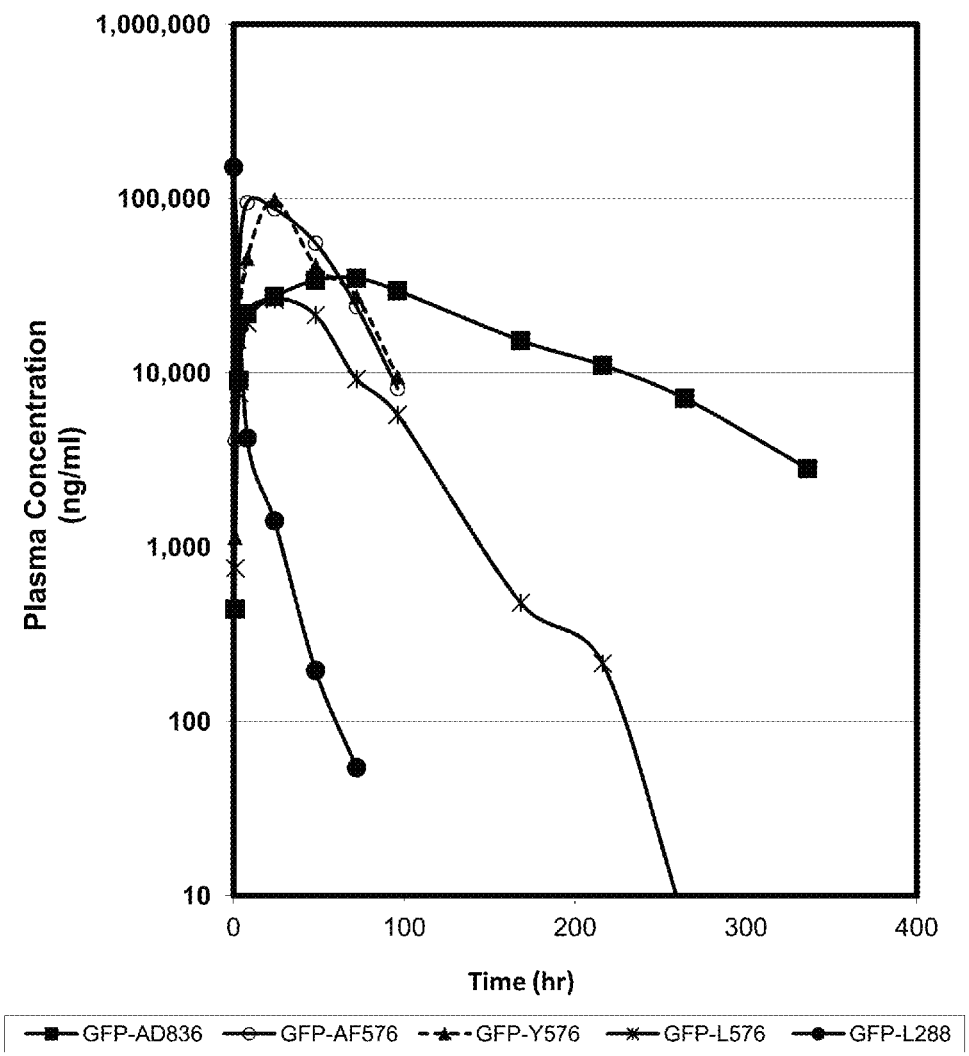
FIG. 31 shows the pharmacokinetic profile (plasma concentrations) in cynomolgus monkeys after single doses of different compositions of GFP linked to unstructured polypeptides of varying length, administered either subcutaneously or intravenously, as described in Example 53. The compositions were GFP-L288, GFP-L576, GFP-XTEN_AF576, GFP—Y576 and XTEN_AD836-GFP. Blood samples were analyzed at various times after injection and the concentration of GFP in plasma was measured by ELISA using a polyclonal antibody against GFP for capture and a biotinylated preparation of the same polyclonal antibody for detection. Results are presented as the plasma concentration versus time (h) after dosing and show, in particular, a considerable increase in half-life for the XTEN_AD836-GFP, the composition with the longest sequence length of XTEN. The construct with the shortest sequence length, the GFP-L288 had the shortest half-life.

The pharmacokinetics of GFP-L288, GFP-L576, GFP-XTEN_AF576, GFP-XTEN_Y576 and XTEN_AD836-GFP were tested in cynomolgus monkeys to determine the effect of composition and length of the unstructured polypeptides on PK parameters. Blood samples were analyzed at various times after injection and the concentration of GFP in plasma was measured by ELISA using a polyclonal antibody against GFP for capture and a biotinylated preparation of the same polyclonal antibody for detection. Results are summarized in FIG. 31. They show a surprising increase of half-life with increasing length of the XTEN sequence. For example, a half-life of 10 h was determined for GFP-XTEN_L288 (with 288 amino acid residues in the XTEN). Doubling the length of the unstructured polypeptide fusion partner to 576 amino acids increased the half-life to 20-22 h for multiple fusion protein constructs; i.e., GFP-XTEN_L576, GFP-XTEN_AF576, GFP-XTEN_Y576. A further increase of the unstructured polypeptide fusion partner length to 836 residues resulted in a half-life of 72-75 h for XTEN_AD836-GFP. Thus, increasing the polymer length by 288 residues from 288 to 576 residues increased in vivo half-life by about 10 h. However, increasing the polypeptide length by 260 residues from 576 residues to 836 residues increased half-life by more than 50 h. These results show that there is a surprising threshold of unstructured polypeptide length that results in a greater than proportional gain in in vivo half-life. Thus, fusion proteins comprising extended, unstructured polypeptides are expected to have the property of enhanced pharmacokinetics compared to polypeptides of shorter lengths.

Example 54

Increasing Solubility and Stability of a Peptide Payload by Linking to XTEN

In order to evaluate the ability of XTEN to enhance the physicochemical properties of solubility and stability, fusion proteins of glucagon plus shorter-length XTEN were prepared and evaluated. The test articles were prepared in Tris-buffered saline at neutral pH and characterization of the Gcg-XTEN solution was by reverse-phase HPLC and size exclusion chromatography to affirm that the protein was homogeneous and non-aggregated in solution. The data are presented in Table 29. For comparative purposes, the solubility limit of unmodified glucagon in the same buffer was measured at 60 µM (0.2 mg/mL), and the result demonstrate that for all lengths of XTEN added, a substantial increase in solubility was attained. Importantly, in most cases the glucagon-XTEN fusion proteins were prepared to achieve target concentrations and were not evaluated to determine the maximum solubility limits for the given construct. However, in the case of glucagon linked to the AF-144 XTEN, the limit of solubility was determined, with the result that a 60-fold increase in solubility was achieved, compared to glucagon not linked to XTEN. In addition, the glucagon-AF144 CFX-TEN was evaluated for stability, and was found to be stable in liquid formulation for at least 6 months under refrigerated conditions and for approximately one month at 37° C. (data not shown).

The data support the conclusion that the linking of short-length XTEN polypeptides to a biologically active protein such as glucagon can markedly enhance the solubility properties of the protein by the resulting fusion protein, as well as confer stability at the higher protein concentrations.

TABLE 29

Solubility of Glucagon-XTEN constructs

| Test Article | Solubility |
| --- | --- |
| Glucagon | 60 µM |
| Glucagon-Y36 | >370 µM |
| Glucagon-Y72 | >293 µM |
| Glucagon-AF108 | >145 µM |
| Glucagon-AF120 | >160 µM |
| Glucagon-Y144 | >497 µM |
| Glucagon-AE144 | >467 µM |

TABLE 29-continued

Solubility of Glucagon-XTEN constructs

| Test Article | Solubility |
| --- | --- |
| Glucagon-AF144 | >3600 µM |
| Glucagon-Y288 | >163 µM |

Example 55

Binding Fusion Proteins with Cleavage Sequences

C-Terminal XTEN Releasable by FXIa

A fusion protein consisting of an XTEN protein fused to the C-terminus of a targeting moiety can be created with a XTEN release site cleavage sequence placed in between the targeting moiety and XTEN components. In this case, the release site cleavage sequence can be incorporated into the XTEN that contains an amino acid sequence that is recognized and cleaved by the FXIa protease (EC 3.4.21.27, Uniprot P03951). Specifically the amino acid sequence KLTRAET (SEQ ID NO: 748) is cut after the arginine of the sequence by FXIa protease. FXI is the pro-coagulant protease located immediately before FVIII in the intrinsic or contact activated coagulation pathway. Active FXIa is produced from FXI by proteolytic cleavage of the zymogen by FXIIa. Production of FXIa is tightly controlled and only occurs when coagulation is necessary for proper hemostasis. Therefore, by incorporation of the KLTRAET (SEQ ID NO: 748) cleavage sequence, the XTEN domain is removed from targeting moiety concurrent with activation of the intrinsic coagulation pathway in proximity to the targeting moiety-XTEN. This creates a situation where the targeting moiety-XTEN fusion protein is processed in one additional manner during the activation of the intrinsic pathway.

C-terminal XTEN Releasable by Elastase-2

A fusion protein consisting of an XTEN protein fused to the C-terminus of a targeting moiety can be created with a XTEN release site cleavage sequence placed in between the targeting moiety and XTEN components. In this case, the release site contains an amino acid sequence that is recognized and cleaved by the elastase-2 protease (EC 3.4.21.37, Uniprot P08246). Specifically the sequence LGPVSGVP (SEQ ID NO: 749) [Rawlings N. D., et al. (2008) *Nucleic Acids Res.*, 36: D320], is cut after position 4 in the sequence. Elastase is constitutively expressed by neutrophils and is present at all times in the circulation, but particularly during acute inflammation. Therefore as the long lived targeting moiety-XTEN circulates, a fraction of it is cleaved, particularly locally during inflammatory responses, creating a pool of shorter-lived targeting moiety to be used at the site of inflammation.

C-Terminal XTEN Releasable by MMP-12

A fusion protein consisting of an XTEN protein fused to the C-terminus of a targeting moiety can be created with a XTEN release site cleavage sequence placed in between the targeting moiety and XTEN components. In this case, the release site contains an amino acid sequence that is recognized and cleaved by the MMP-12 protease (EC 3.4.24.65, Uniprot P39900). Specifically the sequence GPAGLGGA (SEQ ID NO: 750) [Rawlings N. D., et al. (2008) *Nucleic Acids Res.*, 36: D320], is cut after position 4 of the sequence. MMP-12 is constitutively expressed in whole blood. Therefore as the long lived AAT-XTEN circulates, a fraction of it is cleaved, creating a pool of shorter-lived AAT to be used. In a desirable feature of the inventive composition, this creates a circulating pro-drug depot that constantly releases a prophylactic amount of targeting moiety, with higher amounts released during an inflammatory response.

C-Terminal XTEN Releasable by MMP-13

A fusion protein consisting of an XTEN protein fused to the C-terminus of a targeting moiety can be created with a XTEN release site cleavage sequence placed in between the targeting moiety and XTEN components. In this case, the release site contains an amino acid sequence that is recognized and cleaved by the MMP-13 protease (EC 3.4.24.-, Uniprot P45452). Specifically the sequence GPAGLRGA (SEQ ID NO: 751) [Rawlings N. D., et al. (2008) *Nucleic Acids Res.*, 36: D320], is cut after position 4. MMP-13 is constitutively expressed in whole blood. Therefore as the long lived targeting moiety-XTEN circulates, a fraction of it is cleaved, creating a pool of shorter-lived AAT to be used. In a desirable feature of the inventive composition, this creates a circulating pro-drug depot that constantly releases a prophylactic amount of targeting moiety, with higher amounts released during an inflammatory response.

C-Terminal XTEN Releasable by MMP-17

A fusion protein consisting of an XTEN protein fused to the C-terminus of a targeting moiety can be created with a XTEN release site cleavage sequence placed in between the targeting moiety and XTEN components. In this case, the release site contains an amino acid sequence that is recognized and cleaved by the MMP-20 protease (EC.3.4.24.-, Uniprot Q9ULZ9). Specifically the sequence APLGLRLR (SEQ ID NO: 752) [Rawlings N. D., et al. (2008) *Nucleic Acids Res.*, 36: D320], is cut after position 4 in the sequence. MMP-17 is constitutively expressed in whole blood. Therefore as the long lived targeting moiety-XTEN circulates, a fraction of it is cleaved, creating a pool of shorter-lived targeting moiety to be used. In a desirable feature of the inventive composition, this creates a circulating pro-drug depot that constantly releases a prophylactic amount of targeting moiety, with higher amounts released during an inflammatory response.

C-Terminal XTEN Releasable by MMP-20

A fusion protein consisting of an XTEN protein fused to the C-terminus of a targeting moiety can be created with a XTEN release site cleavage sequence placed in between the targeting moiety and XTEN components. In this case, the release site contains an amino acid sequence that is recognized and cleaved by the MMP-20 protease (EC.3.4.24.-, Uniprot O60882). Specifically the sequence PALPLVAQ (SEQ ID NO: 753) [Rawlings N. D., et al. (2008) *Nucleic Acids Res.*, 36: D320], is cut after position 4 (depicted by the arrow). MMP-20 is constitutively expressed in whole blood. Therefore as the long lived targeting moiety-XTEN circulates, a fraction of it is cleaved, creating a pool of shorter-lived targeting moiety to be used. In a desirable feature of the inventive composition, this creates a circulating pro-drug depot that constantly releases a prophylactic amount of targeting moiety, with higher amounts released during an inflammatory response.

Example 56

Serum Stability of XTEN

Figure 16:
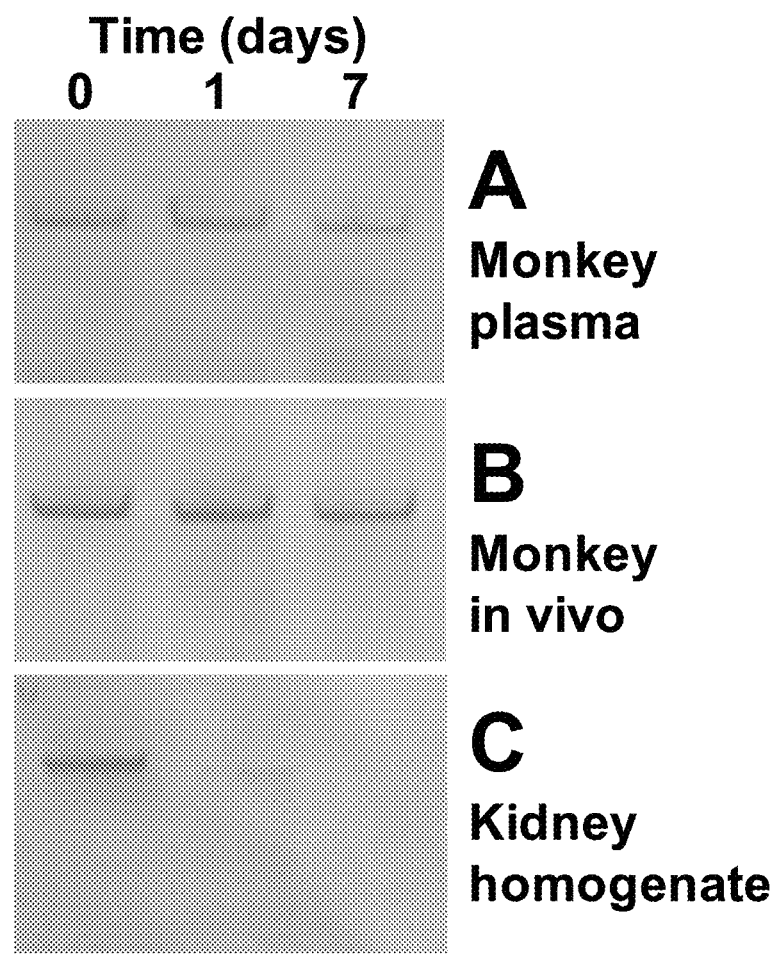
FIG. 16 shows an SDS-PAGE gel of samples from a stability study of the fusion protein of XTEN_AE864 fused to the N-terminus of GFP. The GFP-XTEN was incubated in cynomolgus plasma and rat kidney lysate for up to 7 days at 37° C., as described in Example 56. In addition, GFP-XTEN administered to cynomolgus monkeys was also assessed. Samples were withdrawn at 0, 1 and 7 days and analyzed by SDS PAGE followed by detection using Western analysis and detection with antibodies against GFP.

A fusion protein containing XTEN_AE864 fused to the N-terminus of GFP was incubated in monkey plasma and rat kidney lysate for up to 7 days at 37° C. Samples were withdrawn at time 0, Day 1 and Day 7 and analyzed by SDS PAGE followed by detection using Western analysis and detection with antibodies against GFP as shown in FIG. 16. The sequence of XTEN_AE864 showed negligible signs of degradation over 7 days in plasma. However, XTEN_AE864 was rapidly degraded in rat kidney lysate over 3 days. The in vivo stability of the fusion protein was tested in plasma samples wherein the GFP_AE864 was immunoprecipitated and analyzed by SDS PAGE as described above. Samples that were withdrawn up to 7 days after injection showed very few signs of degradation. The results demonstrate the resistance of binding fusion protein to degradation due to serum proteases; a factor in the enhancement of pharmacokinetic properties of the binding fusion proteins.

Example 57

Analysis of Sequences for Secondary Structure by Prediction Algorithms

Amino acid sequences can be assessed for secondary structure via certain computer programs or algorithms, such as the well-known Chou-Fasman algorithm (Chou, P. Y., et al. (1974) *Biochemistry*, 13: 222-45) and the Garnier-Osguthorpe-Robson, or "GOR" method (Garnier J, Gibrat J F, Robson B. (1996). GOR method for predicting protein secondary structure from amino acid sequence. Methods Enzymol 266:540-553). For a given sequence, the algorithms can predict whether there exists some or no secondary structure at all, expressed as total and/or percentage of residues of the sequence that form, for example, alpha-helices or beta-sheets or the percentage of residues of the sequence predicted to result in random coil formation.

Several representative sequences from XTEN "families" have been assessed using two algorithm tools for the Chou-Fasman and GOR methods to assess the degree of secondary structure in these sequences. The Chou-Fasman tool was provided by William R. Pearson and the University of Virginia, at the "Biosupport" internet site, URL located on the World Wide Web at .fasta.bioch.virginia.edu/fasta_www2/fasta_www.cgi?rm=misc1 as it existed on Jun. 19, 2009. The GOR tool was provided by Pole Informatique Lyonnais at the Network Protein Sequence Analysis internet site, URL located on the World Wide Web at .npsa-pbil.ibcp.fr/cgi-bin/secpred_gor4.pl as it existed on Jun. 19, 2008.

As a first step in the analyses, a single XTEN sequence was analyzed by the two algorithms. The AE864 composition is a XTEN with 864 amino acid residues created from multiple copies of four 12 amino acid sequence motifs consisting of the amino acids G, S, T, E, P, and A. The sequence motifs are characterized by the fact that there is limited repetitiveness within the motifs and within the overall sequence in that the sequence of any two consecutive amino acids is not repeated more than twice in any one 12 amino acid motif, and that no three contiguous amino acids of full-length the XTEN are identical. Successively longer portions of the AF 864 sequence from the N-terminus were analyzed by the Chou-Fasman and GOR algorithms (the latter requires a minimum length of 17 amino acids). The sequences were analyzed by entering the FASTA format sequences into the prediction tools and running the analysis. The results from the analyses are presented in Table 30.

The results indicate that, by the Chou-Fasman calculations, short XTEN of the AE and AG families, up to at least 288 amino acid residues, have no alpha-helices or beta sheets, but amounts of predicted percentage of random coil by the GOR algorithm vary from 78-99%. With increasing XTEN lengths of 504 residues to greater than 1300, the XTEN analyzed by the Chou-Fasman algorithm had predicted percentages of alpha-helices or beta sheets of 0 to about 2%, while the calculated percentages of random coil increased to from 94-99%. Those XTEN with alpha-helices or beta sheets were those sequences with one or more instances of three contiguous serine residues, which resulted in predicted beta-sheet formation. However, even these sequences still had approximately 99% random coil formation.

The analysis supports the conclusion that: 1) XTEN created from multiple sequence motifs of G, S, T, E, P, and A that have limited repetitiveness as to contiguous amino acids are predicted to have very low amounts of alpha-helices and beta-sheets; 2) that increasing the length of the XTEN does not appreciably increase the probability of alpha-helix or beta-sheet formation; and 3) that progressively increasing the length of the XTEN sequence by addition of non-repetitive 12-mers consisting of the amino acids G, S, T, E, P, and A results in increased percentage of random coil formation. Based on the numerous sequences evaluated by these methods, it is concluded that XTEN created from sequence motifs of G, S, T, E, P, and A that have limited repetitiveness (defined as no more than two identical contiguous amino acids in any one motif) are expected to have very limited secondary structure. With the exception of motifs containing three contiguous serines, it is believed that any order or combination of sequence motifs from Table 3 can be used to create an XTEN polypeptide that will result in an XTEN sequence that is substantially devoid of secondary structure, and that the effects of three contiguous serines is ameliorated by increasing the length of the XTEN. Such sequences are expected to have the characteristics described in the CFXTEN embodiments of the invention disclosed herein.

TABLE 30

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| AE36: LCW0402_002 | GSPAGSPTSTEEGTSESATPES GPGTSTEPSEGSAP | 754 | 36 | Residue totals: H: 0 E: 0 percent: H: 0.0 E: 0.0 | 94.44% |
| AE36: LCW0402_003 | GTSTEPSEGSAPGTSTEPSEGS APGTSTEPSEGSAP | 755 | 36 | Residue totals: H: 0 E: 0 percent: H: 0.0 E: 0.0 | 94.44% |
| AG36: LCW0404_001 | GASPGTSSTGSPGTPGSGTASS SPGSSTPSGATGSP | 756 | 36 | Residue totals: H: 0 E: 0 percent: H: 0.0 E: 0.0 | 77.78% |
| AG36: LCW0404_003 | GSSTPSGATGSPGSSPSASTGT GPGSSTPSGATGSP | 757 | 36 | Residue totals: H: 0 E: 0 percent: H: 0.0 E: 0.0 | 83.33% |
| AE42_1 | TEPSEGSAPGSPAGSPTSTEEG TSESATPESGPGSEPATSGS | 758 | 42 | Residue totals: H: 0 E: 0 percent: H: 0.0 E: 0.0 | 90.48% |
| AE42_1 | TEPSEGSAPGSPAGSPTSTEEG TSESATPESGPGSEPATSGS | 759 | 42 | Residue totals: H: 0 E: 0 percent: H: 0.0 E: 0.0 | 90.48% |
| AG42_1 | GAPSPSASTGTGPGTPGSGTAS SSPGSSTPSGATGSPGPSGP | 760 | 42 | Residue totals: H: 0 E: 0 percent: H: 0.0 E: 0.0 | 88.10% |
| AG42_2 | GPGTPGSGTASSSPGSSTPSGA TGSPGSSPSASTGTGPGASP | 761 | 42 | Residue totals: H: 0 E: 0 percent: H: 0.0 E: 0.0 | 88.10% |
| AE144 | GSEPATSGSETPGTSESATPES GPGSEPATSGSETPGSPAGSPT STEEGTSTEPSEGSAPGSEPATS GSETPGSEPATSGSETPGSEPA TSGSETPGTSTEPSEGSAPGTSE SATPESGPGSEPATSGSETPGTS TEPSEGSAP | 762 | 144 | Residue totals: H: 0 E: 0 percent: H: 0.0 E: 0.0 | 98.61% |
| AG144_1 | PGSSPSASTGTGPGSSPSASTGT GPGTPGSGTASSSPGSSTPSGA TGSPGSSPSASTGTGPGASPGT SSTGSPGTPGSGTASSSPGSSTP SGATGSPGTPGSGTASSSPGAS PGTSSTGSPGASPGTSSTGSPG TPGSGTASSS | 763 | 144 | Residue totals: H: 0 E: 0 percent: H: 0.0 E: 0.0 | 91.67% |
| AE288 | GTSESATPESGPGSEPATSGSE TPGTSESATPESGPGSEPATSGS ETPGTSESATPESGPGTSTEPSE GSAPGSPAGSPTSTEEGTSESA TPESGPGSEPATSGSETPGTSES ATPESGPGSPAGSPTSTEEGSP AGSPTSTEEGTSTEPSEGSAPG TSESATPESGPGTSESATPESGP GTSESATPESGPGSEPATSGSE TPGSEPATSGSETPGSPAGSPTS TEEGTSTEPSEGSAPGTSTEPSE GSAPGSEPATSGSETPGTSESA TPESGPGTSTEPSEGSAP | 764 | 288 | Residue totals: H: 0 E: 0 percent: H: 0.0 E: 0.0 | 99.31% |

TABLE 30-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| AG288_2 | GSSPSASTGTGPGSSPSASTGT GPGTPGSGTASSSPGSSTPSGA TGSPGSSPSASTGTGPGASPGT SSTGSPGTPGSGTASSSPGSSTP SGATGSPGTPGSGTASSSPGAS PGTSSTGSPGASPGTSSTGSPG TPGSGTASSSPGSSTPSGATGSP GASPGTSSTGSPGTPGSGTASS SPGSSTPSGATGSPGSSPSASTG TGPGSSPSASTGTGPGSSTPSG ATGSPGSSTPSGATGSPGASPG TSSTGSPGASPGTSSTGSPGASP GTSSTGSPGTPGSGTASSSP | 765 | 288 | Residue totals: H: 0 E: 0 percent: H: 0.0 E: 0.0 | 92.71 |
| AF504 | GASPGTSSTGSPGSSPSASTGT GPGSSPSASTGTGPGTPGSGTA SSSPGSSTPSGATGSPGSNPSAS TGTGPGASPGTSSTGSPGTPGS GTASSSPGSSTPSGATGSPGTP GSGTASSSPGASPGTSSTGSPG ASPGTSSTGSPGTPGSGTASSSP GSSTPSGATGSPGASPGTSSTG SPGTPGSGTASSSPGSSTPSGAT GSPGSNPSASTGTGPGSSPSAS TGTGPGSSTPSGATGSPGSSTP SGATGSPGASPGTSSTGSPGAS PGTSSTGSPGASPGTSSTGSPG TPGSGTASSSPGASPGTSSTGSP GASPGTSSTGSPGASPGTSSTG SPGSSPSASTGTGPGTPGSGTA SSSPGASPGTSSTGSPGASPGTS STGSPGASPGTSSTGSPGSSTPS GATGSPGSSTPSGATGSPGASP GTSSTGSPGTPGSGTASSSPGSS TPSGATGSPGSSTPSGATGSPG SSTPSGATGSPGSSPSASTGTGP GASPGTSSTGSP | 766 | 504 | Residue totals: H: 0 E: 0 percent: H: 0.0 E: 0.0 | 94.44% |
| AD 576 | GSSESGSSEGGPGSGGEPSESG SSGSSESGSSEGGPGSSESGSSE GGPGSSESGSSEGGPGSSESGSS SEGGPGSSESGSSEGGPGESPG GSSSGSESGSEGSSGPGESSGSSE SGSSEGGPGSSESGSSEGGPGS SESGSSEGGPGSGGEPSESGSS GESPGGSSGSESGESPGGSSGS ESGSGGEPSESGSSGSSESGSSE GGPGSGGEPSESGSSGSGGEPS ESGSSGSEGSSGPGESSGESPG GSSGSESGSGGEPSESGSSGSG GEPSESGSSGSGGEPSESGSSGS SESGSSEGGPGESPGGSSGSES GESPGGSSGSESGESPGGSSGS ESGESPGGSSGSESGESPGGSS GSESGSSESGSSEGGPGSGGEP SESGSSGSEGSSGPGESSGSSES GSSEGGPGSGGEPSESGSSGSS ESGSSEGGPGSGGEPSESGSSG ESPGGSSGSESGESPGGSSGSES GSSESGSSEGGPGSGGEPSESG SSGSSESGSSEGGPGSGGEPSES GSSGSGGEPSESGSSGESPGGS SGSESGSEGSSGPGESSGSSESG SSEGGPGSEGSSGPGESS | 767 | 576 | Residue totals: H: 7 E: 0 percent: H: 1.2 E: 0.0 | 99.65% |
| AE576 | GSPAGSPTSTEEGTSESATPES GPGTSTEPSEGSAPGSPAGSPT STEEGTSTEPSEGSAPGTSTEPS EGSAPGTSESATPESGPGSEPA TSGSETPGSEPATSGSETPGSPA GSPTSTEEGTSESATPESGPGTS TEPSEGSAPGTSTEPSEGSAPGS PAGSPTSTEEGTSTEPSEGSAP GTSTEPSEGSAPGTSESATPES | 768 | 576 | Residue totals: H: 2 E: 0 percent: H: 0.4 E: 0.0 | 99.65% |

TABLE 30-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | GPGTSTEPSEGSAPGTSESATP ESGPGSEPATSGSETPGTSTEPS EGSAPGTSTEPSEGSAPGTSES ATPESGPGTSESATPESGPGSP AGSPTSTEEGTSESATPESGPG SEPATSGSETPGTSESATPESGP GTSTEPSEGSAPGTSTEPSEGS APGTSTEPSEGSAPGTSTEPSE GSAPGTSTEPSEGSAPGTSTEPS EGSAPGSPAGSPTSTEEGTSTE PSEGSAPGTSESATPESGPGSEP ATSGSETPGTSESATPESGPGS EPATSGSETPGTSESATPESGP GTSTEPSEGSAPGTSESATPES GPGSPAGSPTSTEEGSPAGSPT STEEGSPAGSPTSTEEGTSESAT PESGPGTSTEPSEGSAP | | | | |
| AG576 | PGTPGSGTASSSPGSSTPSGAT GSPGSSPSASTGTGPGSSPSAST GTGPGSSTPSGATGSPGSSTPS GATGSPGASPGTSSTGSPGASP GTSSTGSPGASPGTSSTGSPGT PGSGTASSSPGASPGTSSTGSP GASPGTSSTGSPGASPGTSSTG SPGSSPSASTGTGPGTPGSGTA SSSPGASPGTSSTGSPGASPGTS STGSPGASPGTSSTGSPGSSTPS GATGSPGSSTPSGATGSPGASP GTSSTGSPGTPGSGTASSSPGSS TPSGATGSPGSSTPSGATGSPG SSTPSGATGSPGSSPSASTGTGP GASPGTSSTGSPGASPGTSSTG SPGTPGSGTASSSPGASPGTSST GSPGASPGTSSTGSPGASPGTS STGSPGASPGTSSTGSPGTPGS GTASSSPGSSTPSGATGSPGTP GSGTASSSPGSSTPSGATGSPG TPGSGTASSSPGSSTPSGATGSP GSSTPSGATGSPGSSPSASTGT GPGSSPSASTGTGPGASPGTSS TGSPGTPGSGTASSSPGSSTPSG ATGSPGSSPSASTGTGPGSSPS ASTGTGPGASPGTSSTGS | 769 | 576 | Residue totals: H: 0 E: 3 percent: H: 0.4 E: 0.5 | 99.31% |
| AF540 | GSTSSTAESPGPGSTSSTAESPG PGSTSESPSGTAPGSTSSTAESP GPGSTSSTAESPGPGTSTPESGS ASPGSTSESPSGTAPGTSPSGES STAPGSTSESPSGTAPGSTSESP SGTAPGTSPSGESSTAPGSTSES PSGTAPGSTSESPSGTAPGTSPS GESSTAPGSTSESPSGTAPGSTS ESPSGTAPGSTSESPSGTAPGTS TPESGSASPGSTSESPSGTAPGT STPESGSASPGSTSSTAESPGPG STSSTAESPGPGTSTPESGSASP GTSTPESGSASPGSTSESPSGTA PGTSTPESGSASPGTSTPESGSA SPGSTSESPSGTAPGSTSESPSG TAPGSTSESPSGTAPGSTSSTAE SPGPGTSTPESGSASPGTSTPES GSASPGSTSESPSGTAPGSTSES PSGTAPGTSTPESGSASPGSTSE SPSGTAPGSTSESPSGTAPGTST PESGSASPGTSPSGESSTAPGST SSTAESPGPGTSPSGESSTAPGS TSSTAESPGPGTSTPESGSASPG STSESPSGTAP | 770 | 540 | Residue totals: H: 2 E: 0 percent: H: 0.4 E: 0.0 | 99.65 |
| AD836 | GSSESGSSEGGPGSSESGSSEG GPGESPGGSSGSESGSGGEPSE SGSSGESPGGSSGSESGSESPGG SSGSESGSSESGSSEGGPGSSES | 771 | 836 | Residue totals: H: 0 E: 0 percent: H: 0.0 E: 0.0 | 98.44% |

TABLE 30-continued

CHOU-FASMAN and GOR prediction calculations of polypeptide sequences

| SEQ NAME | Sequence | SEQ ID NO: | Residues | Chou-Fasman Calculation | GOR Calculation |
|---|---|---|---|---|---|
| | GSSEGGPGSSESGSSEGGPGES PGGSSGSESGESPGGSSGSESG ESPGGSSGSESGSSESGSSEGGP GSSESGSSEGGPGSSESGSSEG GPGSSESGSSEGGPGSSESGSSE GGPGSSESGSSEGGPGSGGEPS ESGSSGESPGGSSGSESGESPG GSSGESGSGGEPSESGSSGSE GSSGPGESSGSSESGSSEGGPG SGGEPSESGSSGSEGSSGPGESS GSSESGSSEGGPGSGGEPSESG SSGESPGGSSGSESGSGGEPSES GSSGSGGEPSESGSSGSSESGSS EGGPGSGGEPSESGSSGSGGEP SESGSSGSEGSSGPGESSGESPG GSSGESGSEGSSGPGESSGSE GSSGPGESSGSGGEPSESGSSG SSESGSSEGGPGSSESGSSEGGP GESPGGSSGSESGSGGEPSESG SSGSEGSSGPGESSGESPGGSS GSESGSEGSSGPGSSESGSSEG GPGSGGEPSESGSSGSEGSSGP GESSGSEGSSGPGESSGSEGSS GPGESSGSGGEPSESGSSGSGG EPSESGSSGESPGGSSGSESGES PGGSSGSESGSGGEPSESGSSG SEGSSGPGESSGESPGGSSGSES GSSESGSSEGGPGSSESGSSEG GPGSSESGSSEGGPGSGGEPSE SGSSGSSESGSSEGGPGESPGG SSGSESGSGGEPSESGSSGSSES GSSEGGPGESPGGSSGSESGSG GEPSESGSSGESPGGSSGSESGS GGEPSESGSS | | | | |
| AE864 | GSPAGSPTSTEEGTSESATPES GPGTSTEPSEGSAPGSPAGSPT STEEGTSTEPSEGSAPGTSTEPS EGSAPGTSESATPESGPGSEPA TSGSETPGSEPATSGSETPGSPA GSPTSTEEGTSESATPESGPGTS TEPSEGSAPGTSTEPSEGSAPGS PAGSPTSTEEGTSTEPSEGSAP GTSTEPSEGSAPGTSESATPES GPGTSTEPSEGSAPGTSESATP ESGPGSEPATSGSETPGTSTEPS EGSAPGTSTEPSEGSAPGTSES ATPESGPGTSESATPESGPGSP AGSPTSTEEGTSESATPESGPG SEPATSGSETPGTSESATPESGP GTSTEPSEGSAPGTSTEPSEGS APGTSTEPSEGSAPGTSTEPSE GSAPGTSTEPSEGSAPGTSTEPS EGSAPGSPAGSPTSTEEGTSTE PSEGSAPGTSESATPESGPGSEP ATSGSETPGTSESATPESGPGS EPATSGSETPGTSESATPESGP GTSTEPSEGSAPGTSESATPES GPGSPAGSPTSTEEGSPAGSPT STEEGSPAGSPTSTEEGTSESAT PESGPGTSTEPSEGSAPGTSESA TPESGPGSEPATSGSETPGTSES ATPESGPGSEPATSGSETPGTS ESATPESGPGTSTEPSEGSAPGS PAGSPTSTEEGTSESATPESGP GSEPATSGSETPGTSESATPES GPGSPAGSPTSTEEGSPAGSPT STEEGTSTEPSEGSAPGTSESAT PESGPGTSESATPESGPGTSESA TPESGPGSEPATSGSETPGSEPA TSGSETPGSPAGSPTSTEEGTST EPSEGSAPGTSTEPSEGSAPGSE PATSGSETPGTSESATPESGPG TSTEPSEGSAP | 772 | 864 | Residue totals: H: 2 E: 3 percent: H: 0.2 E: 0.4 | 99.77% |

TABLE 30-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| AF864 | GSTSESPSGTAPGTSPSGESSTAPGSTSESPSGTAPGSTSESPSGTAPGTSTPESGSASPGTSTPESGSASPGTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGTSSTAESPGPGTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGSTSSTAESPGPGTSPSGESSTAPGSTSESPSGTAPGTSPSGESSTAPGSTSESPSGTAPGTSTPESGSASPGTSTPESGSASPGSTSSTAESPGPGTSESPSGTAPGSTSESPSGTAPGTSPSGESSTAPGSTSSTAESPGPGTSPSGESSTAPGTSTPESGSASPGTSPSGESSTAPGSPSGESSTAPGSTSSTAESPGPGTSSTAESPGPGTSSTAESPGPGTSPSGESSTAPGSSPSASTGTGPGSSTPSGATGSPGSSTPSGATGSP | 773 | 875 | Residue totals: H: 2 E: 0 percent: H: 0.2 E: 0.0 | 95.20% |
| AG864 | GASPGTSSTGSPGSSPSASTGTGPGSSPSASTGTGPGTPGSGTASSSPGSSTPSGATGSPGSSPSASTGTGPGASPGTSSTGSPGPTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGASPGTSSTGSPGASPGTSSTGSPGTPGSGTASSSPGASPGTSSTGSPGASPGTSSTGSPGSSPSASTGTGPGTPGSGTASSSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGTPGSGTASSSPGSSTPSGATGSPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPS | 774 | 864 | Residue totals: H: 0 E: 0 percent: H: 0.0 E: 0.0 | 94.91% |

TABLE 30-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | ASTGTGPGASPGTSSTGSPGAS PGTSSTGSPGSSTPSGATGSPGS SPSASTGTGPGASPGTSSTGSP GSSPSASTGTGPGTPGSGTASS SPGSSTPSGATGSPGSSTPSGAT GSPGASPGTSSTGSP | | | | |
| AM875 | GTSTEPSEGSAPGSEPATSGSE TPGSPAGSPTSTEEGSTSSTAES PGPGTSTPESGSASPGSTSESPS GTAPGSTSESPSGTAPGTSTPES GSASPGTSTPESGSASPGSEPA TSGSETPGTSESATPESGPGSPA GSPTSTEEGTSTEPSEGSAPGTS ESATPESGPGTSTEPSEGSAPG TSTEPSEGSAPGSPAGSPTSTEE GTSTEPSEGSAPGTSTEPSEGS APGTSESATPESGPGTSESATP ESGPGTSTEPSEGSAPGTSTEPS EGSAPGTSESATPESGPGTSTE PSEGSAPGSEPATSGSETPGSP AGSPTSTEEGSSTPSGATGSPG TPGSGTASSSPGSSTPSGATGSP GTSTEPSEGSAPGTSTEPSEGS APGSEPATSGSETPGSPAGSPT STEEGSPAGSPTSTEEGTSTEPS EGSAPGASASGAPSTGGTSESA TPESGPGSPAGSPTSTEEGSPA GSPTSTEEGSTSSTAESPGPGST SESPSGTAPGTSPSGESSTAPGT PGSGTASSSPGSSTPSGATGSP GSSPSASTGTGPGSEPATSGSE TPGTSESATPESGPGSEPATSGS ETPGSTSSTAESPGPGSTSSTAE SPGPGTSPSGESSTAPGSEPATS GSETPGSEPATSGSETPGTSTEP SEGSAPGSTSSTAESPGPGTSTP ESGSASPGSTSESPSGTAPGTST EPSEGSAPGTSTEPSEGSAPGTS TEPSEGSAPGSSTPSGATGSPG SSPSASTGTGPGASPGTSSTGSP GSEPATSGSETPGTSESATPES GPGSPAGSPTSTEEGSSTPSGA TGSPGSSPSASTGTGPGASPGT SSTGSPGTSESATPESGPGTSTE PSEGSAPGTSTEPSEGSAP | 775 | 875 | Residue totals: H: 7 E: 3 percent: H: 0.8 E: 0.3 | 98.63% |
| AM1318 | GTSTEPSEGSAPGSEPATSGSE TPGSPAGSPTSTEEGSTSSTAES PGPGTSTPESGSASPGSTSESPS GTAPGSTSESPSGTAPGTSTPES GSASPGTSTPESGSASPGSEPA TSGSETPGTSESATPESGPGSPA GSPTSTEEGTSTEPSEGSAPGTS ESATPESGPGTSTEPSEGSAPG TSTEPSEGSAPGSPAGSPTSTEE GTSTEPSEGSAPGTSTEPSEGS APGTSESATPESGPGTSESATP ESGPGTSTEPSEGSAPGTSTEPS EGSAPGTSESATPESGPGTSTE PSEGSAPGSEPATSGSETPGSP AGSPTSTEEGSSTPSGATGSPG TPGSGTASSSPGSSTPSGATGSP GTSTEPSEGSAPGTSTEPSEGS APGSEPATSGSETPGSPAGSPT STEEGSPAGSPTSTEEGTSTEPS EGSAPGPEPTGPAPSGGSEPAT SGSETPGTSESATPESGPGSPA GSPTSTEEGTSESATPESGPGSP AGSPTSTEEGSPAGSPTSTEEG TSESATPESGPGSPAGSPTSTEE GSPAGSPTSTEEGSTSSTAESPG PGSTSESPSGTAPGTSPSGESST APGSTSESPSGTAPGSTSESPSG | 776 | 1318 | Residue totals: H: 7 E: 0 percent: H: 0.7 E: 0.0 | 99.17% |

TABLE 30-continued

CHOU-FASMAN and GOR prediction calculations of polypeptide sequences

| SEQ NAME | Sequence | SEQ ID NO: | Residues | Chou-Fasman Calculation | GOR Calculation |
|---|---|---|---|---|---|
| | TAPGTSPSGESSTAPGTSTEPSE GSAPGTSESATPESGPGTSESA TPESGPGSEPATSGSETPGTSES ATPESGPGTSESATPESGPGTS TEPSEGSAPGTSESATPESGPG TSTEPSEGSAPGTSPSGESSTAP GTSPSGESSTAPGTSPSGESSTA PGTSTEPSEGSAPGSPAGSPTST EEGTSTEPSEGSAPGSSPSASTG TGPGSSTPSGATGSPGSSTPSG ATGSPGSSTPSGATGSPGSSTPS GATGSPGASPGTSSTGSPGASA SGAPSTGGTSPSGESSTAPGST SSTAESPGPGTSPSGESSTAPGT SESATPESGPGTSTEPSEGSAPG TSTEPSEGSAPGSSPSASTGTGP GSSTPSGATGSPGASPGTSSTG SPGTSTPESGSASPGTSPSGESS TAPGTSPSGESSTAPGTSESATP ESGPGSEPATSGSETPGTSTEPS EGSAPGSTSESPSGTAPGSTSES PSGTAPGTSTPESGSASPGSPA GSPTSTEEGTSESATPESGPGTS TEPSEGSAPGSPAGSPTSTEEG TSESATPESGPGSEPATSGSETP GSSTPSGATGSPGASPGTSSTG SPGSSTPSGATGSPGSTSESPSG TAPGTSPSGESSTAPGSTSSTAE SPGPGSSTPSGATGSPGASPGT SSTGSPGTPGSGTASSSPGSPA GSPTSTEEGSPAGSPTSTEEGTS TEPSEGSAP | | | | |
| AM923 | MAEPAGSPTSTEEGASPGTSST GSPGSSTPSGATGSPGSSTPSG ATGSPGTSTEPSEGSAPGSEPA TSGSETPGSPAGSPTSTEEGSTS STAESPGPGTSTPESGSASPGST SESPSGTAPGSTSESPSGTAPGT STPESGSASPGTSTPESGSASPG SEPATSGSETPGTSESATPESGP GSPAGSPTSTEEGTSTEPSEGS APGTSESATPESGPGTSTEPSE GSAPGTSTEPSEGSAPGSPAGS PTSTEEGTSTEPSEGSAPGTSTE PSEGSAPGTSESATPESGPGTSE SATPESGPGTSTEPSEGSAPGTS TEPSEGSAPGTSESATPESGPG TSTEPSEGSAPGSEPATSGSETP GSPAGSPTSTEEGSSTPSGATG SPGTPGSGTASSSPGSSTPSGAT GSPGTSTEPSEGSAPGTSTEPSE GSAPGSEPATSGSETPGSPAGS PTSTEEGSPAGSPTSTEEGTSTE PSEGSAPGASASGAPSTGGTSE SATPESGPGSPAGSPTSTEEGSP AGSPTSTEEGSTSSTAESPGPGS TSESPSGTAPGTSPSGESSTAPG TPGSGTASSSPGSSTPSGATGSP GSSPSASTGTGPGSEPATSGSE TPGTSESATPESGPGSEPATSGS ETPGSTSSTAESPGPGSTSSTAE SPGPGTSPSGESSTAPGSEPATS GSETPGSEPATSGSETPGTSTEP SEGSAPGSTSSTAESPGPGTSTP ESGSASPGTSESPSGTAPGTSTE PSEGSAPGTSTEPSEGSAPGTS TEPSEGSAPGSSTPSGATGSPG SSPSASTGTGPGASPGTSSTGSP GSEPATSGSETPGTSESATPES GPGSPAGSPTSTEEGSSTPSGA TGSPGSSPSASTGTGPGASPGT SSTGSPGTSESATPESGPGTSTE PSEGSAPGTSTEPSEGSAP | 777 | 924 | Residue totals: H: 4 E: 3 percent: H: 0.4 E: 0.3 | 98.70% |

TABLE 30-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| AE912 | MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGTSGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGSPAGSPTSTEEGSPAGSPTSTEEGSPAGSPTSTEEGSPAGSPTSTEEGSPATSGSETPGSEPATSGSETPGSPAGSPTSTEEGTSTEPSEGSAPGTSTEPSEGSAPGSEPATSGSETPGTSESATPESGPGTSTEPSEGSAP | 778 | 913 | Residue totals: H: 8 E: 3 percent: H: 0.9 E: 0.3 | 99.45% |
| BC 864 | GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSEPSEPGSAGTSTEPSEPGSAGTSEPSTSEPGAGSGASEPTSTEPGTSTEPSEPGSAGTSTEPSEPGSAG | 779 | | Residue totals: H: 0 E: 0 percent: H: 0 E: 0 | 99.77% |

TABLE 30-continued

CHOU-FASMAN and GOR prediction calculations of polypeptide sequences

| SEQ NAME | Sequence | SEQ ID NO: | No. Residues | Chou-Fasman Calculation | GOR Calculation |
|---|---|---|---|---|---|
| | TSTEPSEPGSAGSEPATSGTEPS<br>GSGASEPTSTEPGSEPATSGTE<br>PSGSEPATSGTEPSGSEPATSGT<br>EPSGSEPATSGTEPSGTSEPSTS<br>EPGAGSEPATSGTEPSGSGASE<br>PTSTEPGTSTEPSEPGSAGSEPA<br>TSGTEPSGSGASEPTSTEPGTST<br>EPSEPGSA | | | | |

* H: alpha-helix E: beta-sheet

Example 58

Analysis of Polypeptide Sequences for Repetitiveness

Polypeptide amino acid sequences can be assessed for repetitiveness by quantifying the number of times a shorter subsequence appears within the overall polypeptide. For example, a polypeptide of 200 amino acid residues has 192 overlapping 9-amino acid subsequences (or 9-mer "frames"), but the number of unique 9-mer subsequences will depend on the amount of repetitiveness within the sequence. In the present analysis, different sequences were assessed for repetitiveness by summing the occurrence of all unique 3-mer subsequences for each 3-amino acid frame across the first 200 amino acids of the polymer portion divided by the absolute number of unique 3-mer subsequences within the 200 amino acid sequence. The resulting subsequence score is a reflection of the degree of repetitiveness within the polypeptide. The sequences of Table 31 were analyzed by the algorithm Seg-Score (FIG. 37), which applies Equation I to the first 200 amino acids of a polypeptide. The results, shown in Table 31, indicate that the unstructured polypeptides consisting of 2 or 3 amino acid types have high subsequence scores, while those of consisting of 12 amino acids motifs of the six amino acids G, S, T, E, P, and A with a low degree of internal repetitiveness, have subsequence scores of less than 10, and in some cases, less than 5. For example, the L288 sequence has two amino acid types and has short, highly repetitive sequences, resulting in a subsequence score of 50.0. The polypeptide J288 has three amino acid types but also has short, repetitive sequences, resulting in a subsequence score of 33.3. Y576 also has three amino acid types, but is not made of internal repeats, reflected in the subsequence score of 15.7 over the first 200 amino acids. W576 consists of four types of amino acids, but has a higher degree of internal repetitiveness, e.g., "GGSG" (SEQ ID NO: 780), resulting in a subsequence score of 23.4. The AD576 consists of four types of 12 amino acid motifs, each consisting of four types of amino acids. Because of the low degree of internal repetitiveness of the individual motifs, the overall subsequence score over the first 200 amino acids is 13.6. In contrast, XTEN's consisting of four motifs contains six types of amino acids, each with a low degree of internal repetitiveness have lower subsequence scores; i.e., AE864 (6.1), AF864 (7.5), and AM875 (4.5).

CONCLUSIONS

The results indicate that the combination of 12 amino acid subsequence motifs, each consisting of four to six amino acid types that are essentially non-repetitive, into a longer XTEN polypeptide results in an overall sequence that is non-repetitive. This is despite the fact that each subsequence motif may be used multiple times across the sequence. In contrast, polymers created from smaller numbers of amino acid types resulted in higher subsequence scores, although the actual sequence can be tailored to reduce the degree of repetitiveness to result in lower subsequence scores.

TABLE 31

Subsequence score calculations of polypeptide sequences

| Seq Name | Amino Acid Sequence | SEQ ID NO: | Score |
|---|---|---|---|
| J288 | GSGGEGGSGGEGGSGGEGGSGGEGGSGGEGGSGGEGGSGGEGGSGGEGGSGGEG<br>GSGGEGGSGGEGGSGGEGGSGGEGGSGGEGGSGGEGGSGGEGGSGGEGGSGGEG<br>GSGGEGGSGGEGGSGGEGGSGGEGGSGGEGGSGGEGGSGGEGGSGGEGGSGGEG<br>GSGGEGGSGGEGGSGGEGGSGGEGGSGGEGGSGGEGGSGGEGGSGGEGGSGGEG<br>GSGGEGGSGGEGGSGGEGGSGGEGGSGGEGGSGGEGGSGGEGGSGGEGGSGGEG<br>GSGGEGGSGGEGGSGGEG | 781 | 33.3 |
| K288 | GEGEGGGEGGEGEGGGEGGEGEGGGEGGEGEGGGEGGEGEGGGEGGEGEGGGE<br>GGEGEGGGEGGEGEGGGEGGEGEGGGEGGEGEGGGEGGEGEGGGEGGEGEGGG<br>EGGEGEGGGEGGEGEGGGEGGEGEGGGEGGEGEGGGEGGEGEGGGEGGEGEGG<br>GEGGEGGGGEGGEGEGGGEGGEGEGGGEGGEGEGGGEGGEGEGGGEGGGEGEG<br>GGEGGEGGGGEGGEGEGGGEGGEGEGGGEGGEGEGGGEGGEGEGGGEGGEGE<br>GGGEGGEGEGGGEGGEGEGGGEG | 782 | 46.9 |
| L288 | SSESSESSSESSESSESSSSESSESSESSSESSESSESSSSESSESSSSESSSES<br>SESSSSESSESSESSSSESSSESSSESSESSESSSSESSESSESSSSESSESS<br>SSESSSSESSESSSSESSESSESSSSESSESSESSSSESSESSESSSSESSSES | 783 | 50.0 |

TABLE 31-continued

Subsequence score calculations of polypeptide sequences

| Seq Name | Amino Acid Sequence | SEQ ID NO: | Score |
|---|---|---|---|
| | SSESSSESSSSESSSESSSSESSSESSSSESSSESSESSSSESSSSESSSES SESSSSESSSESSSESSSSESSSESSESSSSES | | |
| Y288 | GEGSGEGSEGEGSEGSGEGEGSEGSGEGEGGSEGSEGEGGSEGSEGEGE GSGEGSEGEGGSEGSEGEGSGEGSEGEGSEGGSEGEGGSEGSEGEGSGEGSEGEGG EGGSEGEGSEGSGEGEGSGEGSEGEGSEGSGEGEGSGEGSEGEGSEGSGEGEGSEG SGEGEGGSEGSEGEGSEGSGEGEGGEGSGEGEGSGEGSEGEGGGEGSEGEGSEG GEGEGSEGGSEGEGGSEGGEGEGSEGSGEGEGSEGGSEGEGSEGGSEGEGSEGSGE GEGSEGSGE | 784 | 26.8 |
| Q576 | GGKPGEGGKPEGGGGKPGGKPEGEGEGKPGGKPEGGGKPGGGEGGKPEGGKPEG EGKPGGGEGKPGGKPEGGGGKPEGEGKPGGGGGKPGGKPEGEGKPGGGEGGKPE GKPGEGGGEGKPGGKPEGGGEGKPGGGKPGEGGKPGEGKPGGGEGGKPEGGKPEG EGKPGGGEGKPGGKPGEGGKPEGGGEGKPGGKPGEGGEGKPGGGKPEGEGKPGG GKPGGGGKPEGEGKPGGKPEGGGGEGKPGGKPEGGGKPEGGGEGKPGGGKPGE GGKPGEGEGKPGGKPEGEGKPGGEGGGKPEGKPGGGEGGKPEGGKPGEGGKPEG GKPGEGGGEGKPGGGKPGEGGKPEGGGKPEGEGKPGGGGKPGEGGKPEGGKPEGG GEGKPGGGKPEGEGKPGGGEGKPGGKPEGGGGKPGEGGKPEGGKPGGGEGGKPE GEGKPGGKPGEGGGKPGGKPEGEGKPGGGEGKPGGKPEGGGGEGKPGGGKPEGG GEGKPGGGKPGEGGKPEGGGKPGEGGKPGEGGKPEGEGKPGGGEGKPGGKPGEG GKPEGGGEGKPGGKPGGEGGGKPEGGKPGEGGKPEG | 785 | 18.5 |
| U576 | GEGKPGGKPGSGGGKPGEGGKPGSGEGKPGGKPGSGGSGKPGGKPGEGGKPEGG SGGKPGGGGKPGGKPGGEGSGKPGGKPEGGGKPEGGSGGKPGGKPEGGSGGKPG GKPGSGEGGKPGGGKPGGEGKPGSGKPGGEGSGKPGGKPEGGSGGKPGGKPEGG SGGKPGGSGKPGGKPGEGGKPEGGSGGKPGGSGKPGGKPEGGGSGKPGGKPGEG GKPGSGEGGKPGGKPGGEGKPGSGKPGGEGSGKPGGKPGSGGEGKPGGKPGEGG SGGKPGGGKPGGEGKPGSGGKPGEGGKPGSGGGKPGGKPGGEGEGKPGGKPGEG GKPGGEGSGKPGGGGKPGGKPGGEGGKPEGSGKPGGGSGKPGGKPEGGGGKPEG SGKPGGGGKPEGSGKPGGGKPEGGSGGKPGGSGKPGGKPGEGGGKPEGSGKPGG GSGKPGGKPEGGGKPEGGSGGKPGGKPEGGSGGKPGGKPGGEGSGKPGGKPGSG EGGKPGGKPGEGSGGKPGGKPEGGSGGKPGGSGKPGGKPEGGGSGKPGGKPGEG GKPGGEGSGKPGGSGKPG | 786 | 18.1 |
| W576 | GGSGKPGKPGGSGSGKPGSGKPGGGSGKPGSGKPGGGSGKPGSGKPGGGSGKPGS GKPGGGGKPGSGSGKPGGGKPGGSGKPGGGSGKPGKPGSGGSGKPGSGKPGGGG SGGKPGKPGSGGSGGKPGKPGSGGGSGKPGKPGSGGSGGKPGKPGSGGSGGKPG KPGSGGSGKPGSGKPGGGSGKPGSGKPGSGGSGKPGKPGSGGSGKPGSGKPGSGS GKPGSGKPGGGSGKPGSGKPGSGGSGKPGKPGSGGGKPGSGSGKPGGGKPGSGSG KPGGGKPGGSGKPGGSGGKPGKPGSGGGSGKPGKPGSGGGSGKPGKPGSGSG KPGSGKPGGGSGKPGSGKPGSGGSGKPGKPGSGGSGGKPGKPGSGGGKPGSGSGK PGGGKPGSGSGKPGGGKPGSGSGKPGGGKPGSGSGKPGGSGKPGSGKPGGGSGG KPGKPGSGGSGKPGSGKPGSGGSGKPGKPGGSGSGKPGSGKPGGGSGKPGSGKPG GGSGKPGSGKPGGSGKPGSGKPGGGGKPGSGSGKPGGSGKPGGSGGKPGKPGSGGSGGK PGKPGSGGSGKPGSGKPGGGSGGKPGKPGSGG | 787 | 23.4 |
| Y576 | GEGSGEGSEGEGSEGSGEGEGSEGSGEGEGGSEGSEGEGSEGSGEGGESGEGE GSGEGSEGEGGSEGSEGSGEGEGSEGGSEGEGGSEGSEGEGSEGSGEGEGSGEGEG SEGGSEGEGSEGGSEGEGSEGSGEGEGSGEGEGSEGSGEGEGSEGSGEGEGSE GGSEGEGGSEGSEGEGSGEGSGEGEGGSEGSGEGEGSGEGSGEGSEGSEGEGGSEG SEGEGGSEGSEGEGGEGSGEGEGSEGSGEGEGSGEGSEGEGSEGSGEGEGSEGSGE GEGSEGSGEGEGSGEGGSGEGEGSGEGEGSGEGSGEGGEGSGEGEGSEGSGEGEGE GGSEGSGEGGSGEGSEGEGGSGEGEGSGEGEGSGEGEGSEGSEGSGEGEGSEGSGE SEGEGSEGGSEGEGSGEGSGEGSEGSEGEGSGEGSGEGSGEGEGSEGSGEGEGGSG EGEGSGEGSEGEGGSEGGEGEGSEGGSEGSGEGGSEGSEGEGGSGEGEGGGEGSE GEGSEGSGEGEGSGEGSE | 788 | 15.7 |
| AD576 | GSSESGSSEGGPGSGGEPSESGSSGSSESGSSEGGPGSSESGSSEGGPGSSESGSSEGG PGSSESGSSEGGPGSSESGSSEGGPGESPGGSSGSESGSESGSGPGESSGSSESGSSEG GPGSSESGSSEGGPGSSGGEPSEGSSGSPGGSSGSESGESPGGSS GSESGSSGGEPSESGSSGSESGSSEGGPGSSGGEPSESGSSGSPGGEPSESGSSGSEGSSG PGESSGESPGGSSGSESGSSGGEPSESGSSGGEPSESGSSGSSGGEPSESGSSGSSESG SSEGGPGESPGGSSGSESGESPGGSSGSESGESPGGSSGSESGESPGGSSGSESGESPG GSSGSESGSSESGSSEGGPGSGGEPSESGSSGSESGSSGPGESSGSSESGSSEGGPGSG GEPSESGSSGSESGSSEGGPGSGGEPSESGSSGSESGSSGPGSSGSESGSESGSSGPGESS SESGSSEGGPGSGGEPSESGSSGSESGSSEGGPGSGGEPSESGSSG ESPGGSSGSESGSEGSSGPGESSGSSESGSSEGGPGSEGSSGPGESS | 789 | 13.6 |
| AE576 | AGSPAGSPTSTEEGTSESATPESGPGTSTEPSEGSAPGSPAGSPTSTEEGTSTEPSEGS APGTSTEPSEGSAPGTSESATPESGPGSEPATSGSETPGSEPATSGSETPGSPAGSPTS TEEGTSESATPESGPGTSTEPSEGSAPGTSTEPSEGSAPGSPAGSPTSTEEGTSTEPSE GSAPGTSTEPSEGSAPGTSESATPESGPGTSTEPSEGSAPGTSESATPESGPGSEPATS GSETPGTSTEPSEGSAPGTSTEPSEGSAPGTSESATPESGPGTSESATPESGPGSPAGS | 790 | 6.1 |

TABLE 31-continued

Subsequence score calculations of polypeptide sequences

| Seq Name | Amino Acid Sequence | SEQ ID NO: | Score |
|---|---|---|---|
|  | PTSTEEGTSESATPESGPGSEPATSGSETPGTSESATPESGPGTSTEPSEGSAPGTSTE PSEGSAPGTSTEPSEGSAPGTSTEPSEGSAPGTSTEPSEGSAPGTSTEPSEGSAPGSPA GSPTSTEEGTSTEPSEGSAPGTSESATPESGPGSEPATSGSETPGTSESATPESGPGSE PATSGSETPGTSESATPESGPGTSTEPSEGSAPGTSESATPESGPGSPAGSPTSTEEGS PAGSPTSTEEGSPAGSPTSTEEGTSESATPESGPGTSTEPSEGSAP |  |  |
| AF540 | GSTSSTAESPGPGSTSSTAESPGPGSTSESPSGTAPGSTSSTAESPGPGSTSSTAESPGP GTSTPESGSASPGSTSESPSGTAPGTSPSGESSTAPGSTSESPSGTAPGSTSESPSGTAP GTSPSGESSTAPGSTSESPSGTAPGSTSESPSGTAPGTSPSGESSTAPGSTSESPSGTAP GSTSESPSGTAPGSTSESPSGTAPGTSTPESGSASPGSTSESPSGTAPGTSTPESGSASP GSTSSTAESPGPGSTSSTAESPGPGTSTPESGSASPGTSTPESGSASPGSTSESPSGTAP GTSTPESGSASPGTSTPESGSASPGSTSESPSGTAPGSTSESPSGTAPGSTSESPSGTAP GSTSSTAESPGPGSTSTPESGSASPGTSTPESGSASPGSTSESPSGTAPGSTSESPSGTAP GSTSTPESGSASPGSTSESPSGTAPGSTSESPSGTAPGTSTPESGSASPGTSPSGESSTAP GSTSSTAESPGPGTSPSGESSTAPGSTSSTAESPGPGTSTPESGSASPGSTSESPSGTAP | 791 | 8.8 |
| AF504 | GASPGTSSTGSPGSSPSASTGTGPGSSPSASTGTGPGTPGSGTASSSPGSSTPSGATGS PGSNPSASTGTGPGASPGTSSTGSPGTPGSGTASSSPGSSTPSGATGSPGASPGTSS SSPGASPGTSSTGSPGASPGTSSTGSPGTPGSGTASSSPGSSTPSGATGSPGASPGTSS TGSPGTPGSGTASSSPGSSTPSGATGSPGSNPSASTGTGPGSSPSASTGTGPGSSTPSG ATGSPGSSTPSGATGSPGASPGTSSTGSPGASPGTSSTGSPGASPGTSSTGSPGTPGS GTASSSPGASPGTSSTGSPGASPGTSSTGSPGASPGTSSTGSPGSSPSASTGTGPGTPG SGTASSSPGASPGTSSTGSPGASPGTSSTGSPGASPGTSSTGSPGSSTPSGATGSPGSS TPSGATGSPGASPGTSSTGSPGTPGSGTASSSPGSSTPSGATGSPGSSTPSGATGSPGS STPSGATGSPGSSPSASTGTGPGASPGTSSTGSP | 792 | 7.0 |
| AE864 | GSPAGSPTSTEEGTSESATPESGPGTSTEPSEGSAPGSPAGSPTSTEEGTSTEPSEGSA PGTSTEPSEGSAPGTSESATPESGPGSEPATSGSETPGSEPATSGSETPGSPAGSPTST EEGTSESATPESGPGTSTEPSEGSAPGTSTEPSEGSAPGSPAGSPTSTEEGTSTEPSEG SAPGTSTEPSEGSAPGTSESATPESGPGTSTEPSEGSAPGTSESATPESGPGSEPATSG SETPGTSTEPSEGSAPGTSTEPSEGSAPGTSESATPESGPGTSESATPESGPGSPAGSP TSTEEGTSESATPESGPGSEPATSGSETPGTSESATPESGPGTSTEPSEGSAPGTSTEP SEGSAPGTSTEPSEGSAPGTSTEPSEGSAPGTSTEPSEGSAPGTSTEPSEGSAPGSPAG SPTSTEEGTSTEPSEGSAPGTSESATPESGPGSEPATSGSETPGTSESATPESGPGSEP ATSGSETPGTSESATPESGPGTSTEPSEGSAPGTSESATPESGPGSPAGSPTSTEEGSP AGSPTSTEEGSPAGSPTSTEEGTSESATPESGPGTSTEPSEGSAPGTSESATPESGPGS EPATSGSETPGTSESATPESGPGSEPATSGSETPGTSESATPESGPGTSTEPSEGSAPG SPAGSPTSTEEGTSESATPESGPGSEPATSGSETPGTSESATPESGPGSPAGSPTSTEE GSPAGSPTSTEEGTSTEPSEGSAPGTSESATPESGPGTSESATPESGPGTSESATPESG PGSEPATSGSETPGSEPATSGSETPGSPAGSPTSTEEGTSTEPSEGSAP | 793 | 6.1 |
| AF864 | GSTSESPSGTAPGTSPSGESSTAPGSTSESPSGTAPGSTSESPSGTAPGTSTPESGSASP GTSTPESGSASPGSTSESPSGTAPGSTSESPSGTAPGTSPSGESSTAPGSTSESPSGTAP GTSPSGESSTAPGTSPSGESSTAPGSTSSTAESPGPGTSPSGESSTAPGTSPSGESSTAP GSTSSTAESPGPGTSTPESGSASPGTSTPESGSASPGSTSESPSGTAPGSTSESPSGTAP GTSTPESGSASPGSTSSTAESPGPGTSTPESGSASPGSTSESPSGTAPGTSPSGESSTAP GSTSSTAESPGPGTSPSGESSTAPGTSTPESGSASPGSTSSTAESPGPGSTSSTAESPGP GSTSSTAESPGPGSTSSTAESPGPGTSPSGESSTAPGSTSESPSGTAPGSTSESPSGTAP GTSTPESGPXXXGASASGAPSTXXXXSESPSGTAPGSTSESPSGTAPGSTSESPSGTA PGSTSESPSGTAPGSTSESPSGTAPGSTSESPSGTAPGTSTPESGSASPGTSPSGESSTA PGTSPSGESSTAPGSTSSTAESPGPGTSPSGESSTAPGTSPSGESSTSESPSGTA PGSTSESPSGTAPGTSPSGESSTAPGSTSESPSGTAPGTSTPESGSASPGTSTPESGSAS PGSTSESPSGTAPGTSTPESGSASPGSTSSTAESPGPGSTSESPSGTAPGSTSESPSGTA PGTSPSGESSTAPGSTSSTAESPGPGTSPSGESSTAPGTSTPESGSASPGTSPSGESSTA PGTSPSGESSTAPGTSPSGESSTAPGSTSSTAESPGPGSTSSTAESPGPGTSPSGESSTA PGSSPSASTGTGPGSSTPSGATGSPGSSTPSGATGSP | 794 | 7.5 |
| AG868 | GGSPGASPGTSSTGSPGSSPSASTGTGPGSSPSASTGTGPGTPGSGTASSSPGSSTPSG ATGSPGSNPSASTGTGPGASPGTSSTGSPGTPGSGTASSSPGSSTPSGATGSPGTPGS GTASSSPGASPGTSSTGSPGASPGTSSTGSPGTPGSGTASSSPGSSTPSGATGSPGASP GTSSTGSPGTPGSGTASSSPGSSTPSGATGSPGSNPSASTGTGPGSSPSASTGTGPGSS TPSGATGSPGSSTPSGATGSPGASPGTSSTGSPGASPGTSSTGSPGASPGTSSTGSPG TPGSGTASSSPGASPGTSSTGSPGASPGTSSTGSPGASPGTSSTGSPGSSPSASTGTGP GTPGSGTASSSPGASPGTSSTGSPGASPGTSSTGSPGASPGTSSTGSPGSSTPSGATGS PGSSTPSGATGSPGASPGTSSTGSPGTPGSGTASSSPGSSTPSGATGSPGSSTPSGATG SPGSSTPSGATGSPGSSPSASTGTGPGASPGTSSTGSPGTPGSGTASSSPGSSTPSG ATGSPGSSTPSGATGSPGSSPSASTGTGPGSSPSASTGTGPGASPGTSSTGSPGTPGS GTASSSPGSSTPSGATGSPGSSPSASTGTGPGSSPSASTGTGPGASPGTSSTGSPGASP GTSSTGSPGSSTPSGATGSPGSSPSASTGTGPGASPGTSSTGSPGSSPSASTGTGPGTP GSGTASSSPGSSTPSGATGSPGSSTPSGATGSPGASPGTSSTGSP | 795 | 7.5 |

TABLE 31-continued

Subsequence score calculations of polypeptide sequences

| Seq Name | Amino Acid Sequence | SEQ ID NO: | Score |
|---|---|---|---|
| AM875 | GTSTEPSEGSAPGSEPATSGSETPGSPAGSPTSTEEGSTSSTAESPGPGTSTPESGSAS PGSTSESPSGTAPGSTSESPSGTAPGTSTPESGSASPGTSTPESGSASPGSEPATSGSE TPGTSESATPESGPGSPAGSPTSTEEGTSTEPSEGSAPGTSESATPESGPGTSTEPSEG SAPGTSTEPSEGSAPGSPAGSPTSTEEGTSTEPSEGSAPGTSTEPSEGSAPGTSESATP ESGPGTSESATPESGPGTSTEPSEGSAPGTSTEPSEGSAPGTSESATPESGPGTSTEPS EGSAPGSEPATSGSETPGSPAGSPTSTEEGSSTPSGATGSPGTPGSGTASSSPGSSTPS GATGSPGTSTEPSEGSAPGTSTEPSEGSAPGSEPATSGSETPGSPAGSPTSTEEGSPA GSPTSTEEGTSTEPSEGSAPGASASGAPSTGGTSESATPESGPGSPAGSPTSTEEGSP AGSPTSTEEGSTSSTAESPGPGSTSESPSGTAPGTSPSGESSTAPGTPGSGTASSSPGS STPSGATGSPGSSPSASTGTGPGSEPATSGSETPGTSESATPESGPGSEPATSGSETPG STSSTAESPGPGSTSSTAESPGPGTSPSGESSTAPGSEPATSGSETPGSEPATSGSETP GTSTEPSEGSAPGSTSSTAESPGPGTSTPESGSASPGSTSESPSGTAPGTSTEPSEGSA PGTSTEPSEGSAPGTSTEPSEGSAPGSSTPSGATGSPGSSPSASTGTGPGASPGTSSTG SPGSEPATSGSETPGTSESATPESGPGSPAGSPTSTEEGSSTPSGATGSPGSSPSASTG TGPGASPGTSSTGSPGTSESATPESGPGTSTEPSEGSAPGTSTEPSEGSAP | 796 | 4.5 |
| AM1318 | GTSTEPSEGSAPGSEPATSGSETPGSPAGSPTSTEEGSTSSTAESPGPGTSTPESGSAS PGSTSESPSGTAPGSTSESPSGTAPGTSTPESGSASPGTSTPESGSASPGSEPATSGSE TPGTSESATPESGPGSPAGSPTSTEEGTSTEPSEGSAPGTSESATPESGPGTSTEPSEG SAPGTSTEPSEGSAPGSPAGSPTSTEEGTSTEPSEGSAPGTSTEPSEGSAPGTSESATP ESGPGTSESATPESGPGTSTEPSEGSAPGTSTEPSEGSAPGTSESATPESGPGTSTEPS EGSAPGSEPATSGSETPGSPAGSPTSTEEGSSTPSGATGSPGTPGSGTASSSPGSSTPS GATGSPGTSTEPSEGSAPGTSTEPSEGSAPGSEPATSGSETPGSPAGSPTSTEEGSPA GSPTSTEEGTSTEPSEGSAPGPEPTGPAPSGGSEPATSGSETPGTSESATPESGPGSPA GSPTSTEEGTSESATPESGPGSPAGSPTSTEEGSPAGSPTSTEEGTSESATPESGPGSP AGSPTSTEEGSPAGSPTSTEEGSTSSTAESPGPGSTSESPSGTAPGTSPSGESSTAPGS TSESPSGTAPGSTSESPSGTAPGTSPSGESSTAPGTSTEPSEGSAPGTSESATPESGPG TSESATPESGPGSEPATSGSETPGTSESATPESGPGTSESATPESGPGTSTEPSEGSAP GTSESATPESGPGTSTEPSEGSAPGTSPSGESSTAPGTSPSGESSTAPGTSPSGESSTA PGTSTEPSEGSAPGSPAGSPTSTEEGTSTEPSEGSAPGSSPSASTGTGPGSSTPSGATG SPGSSTPSGATGSPGSSTPSGATGSPGSSTPSGATGSPGASPGTSSTGSPGASASGAP STGGTSPSGESSTAPGSTSSTAESPGPGTSPSGESSTAPGTSESATPESGPGTSTEPSE GSAPGTSTEPSEGSAPGSSPSASTGTGPGSSTPSGATGSPGASPGTSSTGSPGTSTPES GSASPGTSPSGESSTAPGTSPSGESSTAPGTSESATPESGPGSEPATSGSETPGTSTEP SEGSAPGSTSESPSGTAPGSTSESPSGTAPGTSTPESGSASPGSPAGSPTSTEEGTSES ATPESGPGTSTEPSEGSAPGSPAGSPTSTEEGTSESATPESGPGSEPATSGSETPGSST PSGATGSPGASPGTSSTGSPGSSTPSGATGSPGSTSESPSGTAPGTSPSGESSTAPGST SSTAESPGPGSSTPSGATGSPGASPGTSSTGSPGTPGSGTASSSPGSPAGSPTSTEEGS PAGSPTSTEEGTSTEPSEGSAP | 797 | 4.5 |

Example 59

Calculation of TEPITOPE Scores

TEPITOPE scores of 9mer peptide sequence can be calculated by adding pocket potentials as described by Sturniolo [Sturniolo, T., et al. (1999) Nat Biotechnol, 17: 555]. In the present Example, separate Tepitope scores were calculated for individual HLA alleles. Table 32 shows as an example the pocket potentials for HLA*0101B, which occurs in high frequency in the Caucasian population. To calculate the TEPITOPE score of a peptide with sequence P1-P2-P3-P4-P5-P6-P7-P8-P9, the corresponding individual pocket potentials in Table 32 were added. The HLA*0101B score of a 9mer peptide with the sequence FDKLPRTSG (SEQ ID NO: 798) would be the sum of 0, −1.3, 0, 0.9, 0, −1.8, 0.09, 0, 0.

To evaluate the TEPITOPE scores for long peptides one can repeat the process for all 9mer subsequences of the sequences. This process can be repeated for the proteins encoded by other HLA alleles. Tables 33-36 give pocket potentials for the protein products of HLA alleles that occur with high frequency in the Caucasian population.

TEPITOPE scores calculated by this method range from approximately −10 to +10. However, 9mer peptides that lack a hydrophobic amino acid (FKLMVWY (SEQ ID NO: 799)) in P1 position have calculated TEPITOPE scores in the range of −1009 to −989. This value is biologically meaningless and reflects the fact that a hydrophobic amino acid serves as an anchor residue for HLA binding and peptides lacking a hydrophobic residue in P1 are considered non binders to HLA. Because most XTEN sequences lack hydrophobic residues, all combinations of 9mer subsequences will have TEPITOPEs in the range in the range of −1009 to −989. This method confirms that XTEN polypeptides may have few or no predicted T-cell epitopes.

TABLE 32

Pocket potential for HLA*0101B allele.

| Amino Acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | −2.4 | — | −2.7 | −2 | — | −1.9 |
| E | −999 | 0.1 | −1.2 | −0.4 | — | −2.4 | −0.6 | — | −1.9 |
| F | 0 | 0.8 | 0.8 | 0.08 | — | −2.1 | 0.3 | — | −0.4 |
| G | −999 | 0.5 | 0.2 | −0.7 | — | −0.3 | −1.1 | — | −0.8 |
| H | −999 | 0.8 | 0.2 | −0.7 | — | −2.2 | 0.1 | — | −1.1 |
| I | −1 | 1.1 | 1.5 | 0.5 | — | −1.9 | 0.6 | — | 0.7 |
| K | −999 | 1.1 | 0 | −2.1 | — | −2 | −0.2 | — | −1.7 |
| L | −1 | 1 | 1 | 0.9 | — | −2 | 0.3 | — | 0.5 |
| M | −1 | 1.1 | 1.4 | 0.8 | — | −1.8 | 0.09 | — | 0.08 |

TABLE 32-continued

Pocket potential for HLA*0101B allele.

| Amino Acid | P1 | P2 | P3 | P4 | P5 | P6 | P7 | P8 | P9 |
|---|---|---|---|---|---|---|---|---|---|
| N | −999 | 0.8 | 0.5 | 0.04 | — | −1.1 | 0.1 | — | −1.2 |
| P | −999 | −0.5 | 0.3 | −1.9 | — | −0.2 | 0.07 | — | −1.1 |
| Q | −999 | 1.2 | 0 | 0.1 | — | −1.8 | 0.2 | — | −1.6 |
| R | −999 | 2.2 | 0.7 | −2.1 | — | −1.8 | 0.09 | — | −1 |
| S | −999 | −0.3 | 0.2 | −0.7 | — | −0.6 | −0.2 | — | −0.3 |
| T | −999 | 0 | 0 | −1 | — | −1.2 | 0.09 | — | −0.2 |
| V | −1 | 2.1 | 0.5 | −0.1 | — | −1.1 | 0.7 | — | 0.3 |
| W | 0 | −0.1 | 0 | −1.8 | — | −2.4 | −0.1 | — | −1.4 |
| Y | 0 | 0.9 | 0.8 | −1.1 | — | −2 | 0.5 | — | −0.9 |

TABLE 33

Pocket potential for HLA*0301B allele.

| Amino acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | 2.3 | — | −2.4 | −0.6 | — | −0.6 |
| E | −999 | 0.1 | −1.2 | −1 | — | −1.4 | −0.2 | — | −0.3 |
| F | −1 | 0.8 | 0.8 | −1 | — | −1.4 | 0.5 | — | 0.9 |
| G | −999 | 0.5 | 0.2 | 0.5 | — | −0.7 | 0.1 | — | 0.4 |
| H | −999 | 0.8 | 0.2 | 0 | — | −0.1 | −0.8 | — | −0.5 |
| I | 0 | 1.1 | 1.5 | 0.5 | — | 0.7 | 0.4 | — | 0.6 |
| K | −999 | 1.1 | 0 | −1 | — | 1.3 | −0.9 | — | −0.2 |
| L | 0 | 1 | 1 | 0 | — | 0.2 | 0.2 | — | −0 |
| M | 0 | 1.1 | 1.4 | 0 | — | −0.9 | 1.1 | — | 1.1 |
| N | −999 | 0.8 | 0.5 | 0.2 | — | −0.6 | −0.1 | — | −0.6 |
| P | −999 | −0.5 | 0.3 | −1 | — | 0.5 | 0.7 | — | −0.3 |
| Q | −999 | 1.2 | 0 | 0 | — | −0.3 | −0.1 | — | −0.2 |
| R | −999 | 2.2 | 0.7 | −1 | — | 1 | −0.9 | — | 0.5 |
| S | −999 | −0.3 | 0.2 | 0.7 | — | −0.1 | 0.07 | — | 1.1 |
| T | −999 | 0 | 0 | −1 | — | 0.8 | −0.1 | — | −0.5 |
| V | 0 | 2.1 | 0.5 | 0 | — | 1.2 | 0.2 | — | 0.3 |
| W | −1 | −0.1 | 0 | −1 | — | −1.4 | −0.6 | — | −1 |
| Y | −1 | 0.9 | 0.8 | −1 | — | −1.4 | −0.1 | — | 0.3 |

TABLE 34

Pocket potential for HLA*0401B allele.

| Amino acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | 1.4 | — | −1.1 | −0.3 | — | −1.7 |
| E | −999 | 0.1 | −1.2 | 1.5 | — | −2.4 | 0.2 | — | −1.7 |
| F | 0 | 0.8 | 0.8 | −0.9 | — | −1.1 | −1 | — | −1 |
| G | −999 | 0.5 | 0.2 | −1.6 | — | −1.5 | −1.3 | — | −1 |
| H | −999 | 0.8 | 0.2 | 1.1 | — | −1.4 | 0 | — | 0.08 |
| I | −1 | 1.1 | 1.5 | 0.8 | — | −0.1 | 0.08 | — | −0.3 |
| K | −999 | 1.1 | 0 | −1.7 | — | −2.4 | −0.3 | — | −0.3 |
| L | −1 | 1 | 1 | 0.8 | — | −1.1 | 0.7 | — | −1 |
| M | −1 | 1.1 | 1.4 | 0.9 | — | −1.1 | 0.8 | — | −0.4 |
| N | −999 | 0.8 | 0.5 | 0.9 | — | 1.3 | 0.6 | — | −1.4 |
| P | −999 | −0.5 | 0.3 | −1.6 | — | 0 | −0.7 | — | −1.3 |
| Q | −999 | 1.2 | 0 | 0.8 | — | −1.5 | 0 | — | 0.5 |
| R | −999 | 2.2 | 0.7 | −1.9 | — | −2.4 | −1.2 | — | −1 |
| S | −999 | −0.3 | 0.2 | 0.8 | — | 1 | −0.2 | — | 0.7 |
| T | −999 | 0 | 0 | 0.7 | — | 1.9 | −0.1 | — | −1.2 |
| V | −1 | 2.1 | 0.5 | −0.9 | — | 0.9 | 0.08 | — | −0.7 |
| W | 0 | −0.1 | 0 | −1.2 | — | −1 | −1.4 | — | −1 |
| Y | 0 | 0.9 | 0.8 | −1.6 | — | −1.5 | −1.2 | — | −1 |

TABLE 35

Pocket potential for HLA*0701B allele.

| Amino acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | −1.6 | — | −2.5 | −1.3 | — | −1.2 |
| E | −999 | 0.1 | −1.2 | −1.4 | — | −2.5 | 0.9 | — | −0.3 |
| F | 0 | 0.8 | 0.8 | 0.2 | — | −0.8 | 2.1 | — | 2.1 |
| G | −999 | 0.5 | 0.2 | −1.1 | — | −0.6 | 0 | — | −0.6 |
| H | −999 | 0.8 | 0.2 | 0.1 | — | −0.8 | 0.9 | — | −0.2 |
| I | −1 | 1.1 | 1.5 | 0 | — | −0.5 | 2.4 | — | 3.4 |
| K | −999 | 1.1 | 0 | −1.3 | — | −1.1 | 0.5 | — | −1.1 |
| L | −1 | 1 | 1 | −0.8 | — | −0.9 | 2.2 | — | 3.4 |
| M | −1 | 1.1 | 1.4 | −0.4 | — | −0.8 | 1.8 | — | 2 |
| N | −999 | 0.8 | 0.5 | −1.1 | — | −0.6 | 1.4 | — | −0.5 |
| P | −999 | −0.5 | 0.3 | −1.2 | — | −0.5 | −0.2 | — | −0.6 |
| Q | −999 | 1.2 | 0 | −1.5 | — | −1.1 | 1.1 | — | −0.9 |
| R | −999 | 2.2 | 0.7 | −1.1 | — | −1.1 | 0.7 | — | −0.8 |
| S | −999 | −0.3 | 0.2 | 1.5 | — | 0.6 | 0.4 | — | −0.3 |
| T | −999 | 0 | 0 | 1.4 | — | −0.1 | 0.9 | — | 0.4 |
| V | −1 | 2.1 | 0.5 | 0.9 | — | 0.1 | 1.6 | — | 2 |
| W | 0 | −0.1 | 0 | −1.1 | — | −0.9 | 1.4 | — | 0.8 |
| Y | 0 | 0.9 | 0.8 | −0.9 | — | −1 | 1.7 | — | 1.1 |

TABLE 36

Pocket potential for HLA*1501B allele.

| Amino acid | P1 | P2 | P3 | P4 | P5 | P6 | P7 | P8 | P9 |
|---|---|---|---|---|---|---|---|---|---|
| A | −999 | 0 | 0 | 0 | — | 0 | 0 | — | 0 |
| C | −999 | 0 | 0 | 0 | — | 0 | 0 | — | 0 |
| D | −999 | −1.3 | −1.3 | −0.4 | — | −0.4 | −0.7 | — | −1.9 |
| E | −999 | 0.1 | −1.2 | −0.6 | — | −1 | −0.7 | — | −1.9 |
| F | −1 | 0.8 | 0.8 | 2.4 | — | −0.3 | 1.4 | — | −0.4 |
| G | −999 | 0.5 | 0.2 | 0 | — | 0.5 | 0 | — | −0.8 |
| H | −999 | 0.8 | 0.2 | 1.1 | — | −0.5 | 0.6 | — | −1.1 |
| I | 0 | 1.1 | 1.5 | 0.6 | — | 0.05 | 1.5 | — | 0.7 |
| K | −999 | 1.1 | 0 | −0.7 | — | −0.3 | −0.3 | — | −1.7 |
| L | 0 | 1 | 1 | 0.5 | — | 0.2 | 1.9 | — | 0.5 |
| M | 0 | 1.1 | 1.4 | 1 | — | 0.1 | 1.7 | — | 0.08 |
| N | −999 | 0.8 | 0.5 | −0.2 | — | 0.7 | 0.7 | — | −1.2 |
| P | −999 | −0.5 | 0.3 | −0.3 | — | −0.2 | 0.3 | — | −1.1 |
| Q | −999 | 1.2 | 0 | −0.8 | — | −0.8 | −0.3 | — | −1.6 |
| R | −999 | 2.2 | 0.7 | 0.2 | — | 1 | −0.5 | — | −1 |
| S | −999 | −0.3 | 0.2 | −0.3 | — | 0.6 | 0.3 | — | −0.3 |
| T | −999 | 0 | 0 | −0.3 | — | −0 | 0.2 | — | −0.2 |
| V | 0 | 2.1 | 0.5 | 0.2 | — | −0.3 | 0.3 | — | 0.3 |
| W | −1 | −0.1 | 0 | 0.4 | — | −0.4 | 0.6 | — | −1.4 |
| Y | −1 | 0.9 | 0.8 | 2.5 | — | 0.4 | 0.7 | — | −0.9 |

Example 60

Figure 32:
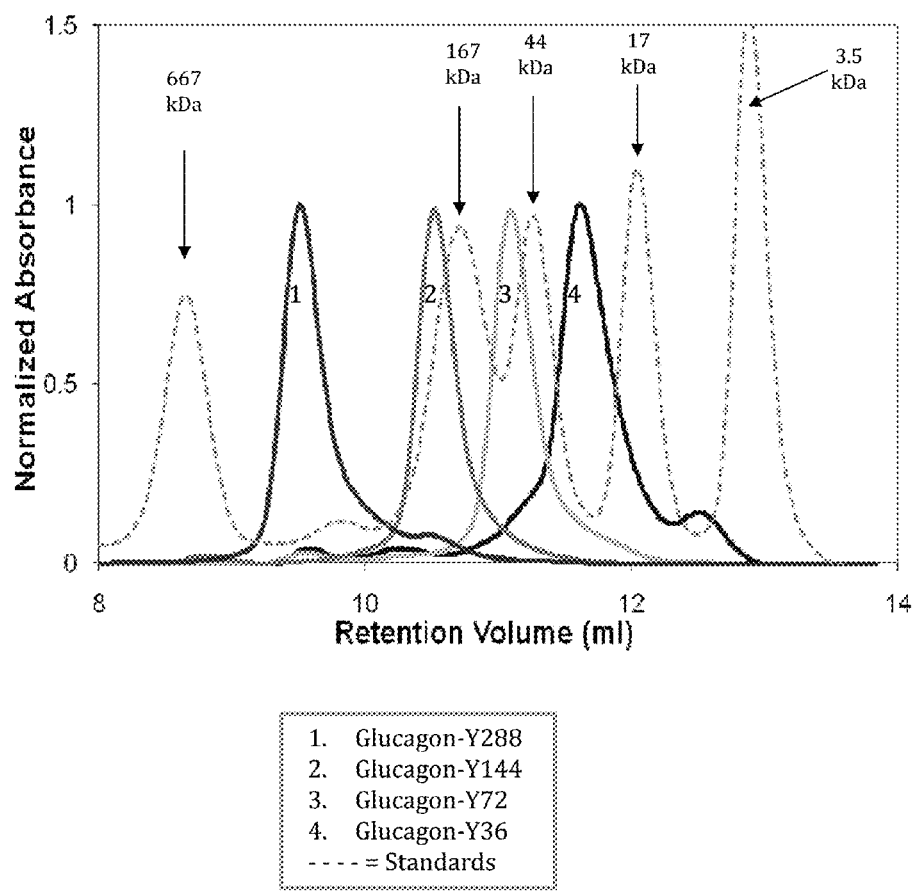
FIG. 32 shows results of a size exclusion chromatography analysis of glucagon-XTEN construct samples measured against protein standards of known molecular weight, with the graph output as absorbance versus retention volume, as described in Example 60. The glucagon-XTEN constructs are 1) glucagon-Y288; 2) glucagonY-144; 3) glucagon-Y72; and 4) glucagon-Y36. The results indicate an increase in apparent molecular weight with increasing length of the XTEN component.

Analytical Size Exclusion Chromatography of XTEN Fusion Proteins with Diverse Payloads Size exclusion chromatography analyses were performed on fusion proteins containing various therapeutic proteins and unstructured recombinant proteins of increasing length. An exemplary assay used a TSKGel-G4000 SWXL (7.8 mm×30 cm) column in which 40 µg of purified glucagon fusion protein at a concentration of 1 mg/ml was separated at a flow rate of 0.6 ml/min in 20 mM phosphate pH 6.8, 114 mM NaCl. Chromatogram profiles were monitored using OD214 nm and OD280 nm Column calibration for all assays were performed using a size exclusion calibration standard from BioRad; the markers include thyroglobulin (670 kDa), bovine gamma-globulin (158 kDa), chicken ovalbumin (44 kDa), equine myoglobuin (17 kDa) and vitamin B12 (1.35 kDa). Representative chromatographic profiles of Glucagon-Y288, Glucagon-Y144, Glucagon-Y72, Glucagon-Y36 are shown as an overlay in FIG. 32. The data show that the apparent molecular weight of each compound is proportional to the length of the attached XTEN sequence. However, the data also show that the apparent molecular weight of each construct is significantly larger than that expected for a globular protein (as shown by comparison to the standard proteins run in the same assay). Based on the SEC analyses for all constructs evaluated, the apparent molecular weights, the apparent molecular weight factor (expressed as the ratio of apparent molecular weight to the calculated molecular weight) and the hydrodynamic radius ($R_H$ in nm) are shown in Table 37. The results indicate that incorporation of different XTENs of 576 amino acids or greater confers an apparent molecular weight for the fusion protein of approximately 339 kDa to 760, and that XTEN of 864 amino acids or greater confers an apparent molecular weight greater than approximately 800 kDA. The results of proportional increases in apparent molecular weight to actual molecular weight were consistent for fusion proteins created with XTEN from several different motif families; i.e., AD, AE, AF, AG, and AM, with increases of at least four-fold and ratios as high as about 17-fold. Additionally, the incorporation of XTEN fusion partners with 576 amino acids or more into fusion proteins with the various payloads (and 288 residues in the case of glucagon fused to Y288) resulted with a hydrodynamic radius of 7 nm or greater; well beyond the glomerular pore size of approximately 3-5 nm. Accordingly, it is expected that fusion proteins comprising growth and XTEN have reduced renal clearance, contributing to increased terminal half-life and improving the therapeutic or biologic effect relative to a corresponding un-fused biologic payload protein.

TABLE 37

SEC analysis of various polypeptides

| Construct Name | XTEN or fusion partner | Therapeutic Protein | Actual MW (kDa) | Apparent MW (kDa) | Apparent Molecular Weight Factor | $R_H$ (nm) |
|---|---|---|---|---|---|---|
| AC14 | Y288 | Glucagon | 28.7 | 370 | 12.9 | 7.0 |
| AC28 | Y144 | Glucagon | 16.1 | 117 | 7.3 | 5.0 |
| AC34 | Y72 | Glucagon | 9.9 | 58.6 | 5.9 | 3.8 |
| AC33 | Y36 | Glucagon | 6.8 | 29.4 | 4.3 | 2.6 |
| AC89 | AF120 | Glucagon | 14.1 | 76.4 | 5.4 | 4.3 |
| AC88 | AF108 | Glucagon | 13.1 | 61.2 | 4.7 | 3.9 |
| AC73 | AF144 | Glucagon | 16.3 | 95.2 | 5.8 | 4.7 |
| AC53 | AG576 | GFP | 74.9 | 339 | 4.5 | 7.0 |
| AC39 | AD576 | GFP | 76.4 | 546 | 7.1 | 7.7 |
| AC41 | AE576 | GFP | 80.4 | 760 | 9.5 | 8.3 |
| AC52 | AF576 | GFP | 78.3 | 526 | 6.7 | 7.6 |
| AC398 | AE288 | FVII | 76.3 | 650 | 8.5 | 8.2 |
| AC404 | AE864 | FVII | 129 | 1900 | 14.7 | 10.1 |
| AC85 | AE864 | Exendin-4 | 83.6 | 938 | 11.2 | 8.9 |

TABLE 37-continued

SEC analysis of various polypeptides

| Construct Name | XTEN or fusion partner | Therapeutic Protein | Actual MW (kDa) | Apparent MW (kDa) | Apparent Molecular Weight Factor | $R_H$ (nm) |
|---|---|---|---|---|---|---|
| AC114 | AM875 | Exendin-4 | 82.4 | 1344 | 16.3 | 9.4 |
| AC143 | AM875 | hGH | 100.6 | 846 | 8.4 | 8.7 |
| AC227 | AM875 | IL-1ra | 95.4 | 1103 | 11.6 | 9.2 |
| AC228 | AM1318 | IL-1ra | 134.8 | 2286 | 17.0 | 10.5 |

Example 61

Construction of CBD-XTEN-Cys, a Cysteine-Engineered XTEN

A Cysteine Island (CysIsland) encoding the amino acid sequence GGSPAGSCTSP (SEQ ID NO: 174) containing one cysteine was introduced by annealed oligos in the CBD-stuffer-GFP vector to obtain CBD-CysIsland-GFP, where CysIsland is flanked by the restriction sites BsaI and BbsI. The CBD-stuffer-GFP vector is a pET30 derivative from Novagen with TEV protease recognition site between CBD and the stuffer. Constructs were previously generated by replacing the stuffer in CBD-stuffer-GFP vector with genes encoding XTEN_AE288 and XTEN_AE576. The plasmid of CBD-XTEN_AE288-GFP was digested with BsaI/NcoI to generate the small fragment as the insert. The plasmid of CBD-CysIsland-GFP was digested with BbsI/NcoI to generate the large fragment as the vector. The insert and vector fragments were ligated and the ligation mixture was electroporated into BL21-Gold (DE3) cells to obtain transformants of CBD-CysIsland-XTEN_AE288-GFP. Similarly, the plasmid of CBD-CysIsland-XTEN_AE288-GFP was digested with BsaI/NcoI to generate the small fragment as the insert. The plasmid of CBD-XTEN_AE576-GFP was digested with BbsI/NcoI to generate the large fragment as the vector. The insert and vector fragments were ligated and the ligation mixture was electroporated into BL21-Gold (DE3) cells to obtain transformants of CBD-XTEN_AE576-CysIsland-XTEN_AE288-GFP. Finally, the plasmid of CBD-XTEN_AE576-CysIsland-XTEN_AE288-GFP was digested with BbsI/HindIII to remove GFP and ligate with annealed oligos for the stop codon, and the ligation mixture was electroporated into BL21-Gold (DE3) cells to obtain transformants of CBD-XTEN_AE576-CysIsland-XTEN_AE288, which has the DNA and encoded amino acid sequences that follow in Table 38. Additional constructs can be created with cysteines inserted at different locations within the XTEN sequence by the selection of restriction sites appropriate for the given location, including multiple insertions. The method could also be utilized to create lysine-engineered XTEN by substitution of codons encoding lysine for those encoding cysteine in the oligonucleotides.

TABLE 38

DNA and amino acid sequence of Cys-engineered XTEN

| Clone Name | DNA Sequence | SEQ ID NO: | Amino Acid Sequence | SEQ ID NO: |
|---|---|---|---|---|
| CBD-TEV-AE576-CysIsland-AE288 | ATGGCAAATACACCGGTATCAGGCAATTTGAAGGTTGAA TTCTACAACAGCAATCCTTCAGATACTACTAACTCAATCA ATCCTCAGTTCAAGGTTACTAATACCGGAAGCAGTGCAA TTGATTTGTCCAAACTCACATTGAGATATTATTATACAGT AGACGGACAGAAAGATCAGACCTTCTGGGCTGACCATGC TGCAATAATCGGCAGTAACGGCAGCTACAACGGAATTAC | 800 | MANTPVSGNLKV EFYNSNPSDTTNS INPQFKVTNTGSS AIDLSKLTLRYYY TVDGQKDQTFW ADHAAIIGSNGSY | 801 |

TABLE 38-continued

DNA and amino acid sequence of Cys-engineered XTEN

| Clone Name | DNA Sequence | Amino Acid Sequence | SEQ ID NO: | SEQ ID NO: |
|---|---|---|---|---|
| | TTCAAATGTAAAAGGAACATTTGTAAAAATGAGTTCCTC | NGITSNVKGTFV | | |
| | AACAAATAACGCAGACACCTACCTTGAAATCAGCTTTAC | KMSSSTNNADTY | | |
| | AGGCGGAACTCTTGAACCGGGTGCACATGTTCAGATACA | LEISFTGGTLEPG | | |
| | AGGTAGATTTGCAAAGAATGACTGGAGTAACTATACACA | AHVQIQGRFAKN | | |
| | GTCAAATGACTACTCATTCAAGTCTGCTTCACAGTTTGTT | DWSNYTQSNDYS | | |
| | GAATGGGATCAGGTAACAGCATACTTGAACGGTGTTCTT | FKSASQFVEWDQ | | |
| | GTATGGGGTAAAGAACCCGGTGGCAGTGTAGTAGGTTCA | VTAYLNGVLVW | | |
| | GGTTCAGGATCCGAAAATCTGTATTTTCAGGGTGGTCTC | GKEPGGSVVGSG | | |
| | CAGGTAGCCCGGCTGGCTCTCCTACCTCTACTGAGGAAG | SGSENLYFQGGSP | | |
| | GTACTTCTGAAAGCGCTACTCCTGAGTCTGGTCCAGGTAC | GSPAGSPTSTEEG | | |
| | CTCTACTGAACCGTCCGAAGGTAGCGCTCCAGGTAGCCC | TSESATPESGPGT | | |
| | AGCAGGCTCTCCGACTTCCACTGAGGAAGGTACTTCTACT | STEPSEGSAPGSP | | |
| | GAACCTTCCGAAGGCAGCGCACCAGGTACCTCTACTGAA | AGSPTSTEEGTST | | |
| | CCTTCTGAGGGCAGCGCTCCAGGTACTTCTGAAAGCGCTA | EPSEGSAPGTSTE | | |
| | CCCCGGAATCTGGCCCAGGTAGCGAACCGGCTACTTCTG | PSEGSAPGTSESA | | |
| | GTTCTGAAACCCCAGGTAGCGAACCGGCTACCTCCGGTTC | TPESGPGSEPATS | | |
| | TGAAACTCCAGGTAGCCCGGCAGGCTCTCCGACCTCTACT | GSETPGSEPATSG | | |
| | GAGGAAGGTACTTCTGAAAGCGCAACCCCGGAGTCCGGC | SETPGSPAGSPTS | | |
| | CCAGGTACCTCTACCGAACCGTCTGAGGGCAGCGCACCA | TEEGTSESATPES | | |
| | GGTACTTCTACCGAACCGTCCGAGGGTAGCGCACCAGGT | GPGTSTEPSEGSA | | |
| | AGCCCAGCAGGTTCTCCTACCTCCACCGAGGAAGGTACTT | PGTSTEPSEGSAP | | |
| | CTACCGAACCGTCCGAGGGTAGCGCACCAGGTACCTCTA | GSPAGSPTSTEEG | | |
| | CTGAACCTTCTGAGGGCAGCGCTCCAGGTACTTCTGAAA | TSTEPSEGSAPGT | | |
| | GCGCTACCCCGGAGTCCGGTCCAGGTACTTCTACTGAACC | STEPSEGSAPGTS | | |
| | GTCCGAAGGTAGCGCACCAGGTACTTCTGAAAGCGCAAC | ESATPESGPGTST | | |
| | CCCTGAATCCGGTCCAGGTAGCGAACCGGCTACTTCTGGC | EPSEGSAPGTSES | | |
| | TCTGAGACTCCAGGTACTTCTACCGAACCGTCCGAAGGTA | ATPESGPGSEPAT | | |
| | GCGCACCAGGTACTTCTACTGAACCGTCTGAAGGTAGCG | SGSETPGTSTEPS | | |
| | CACCAGGTACTTCTGAAAGCGCAACCCCGGAATCCGGCC | EGSAPGTSTEPSE | | |
| | CAGGTACCTCTGAAAGCGCAACCCCGGAGTCCGGCCCAG | GSAPGTSESATPE | | |
| | GTAGCCCTGCTGGCTCTCCAACCTCCACCGAAGAAGGTA | SGPGTSESATPES | | |
| | CCTCTGAAAGCGCAACCCCTGAATCCGGCCCAGGTAGCG | GPGSPAGSPTSTE | | |
| | AACCGGCAACCTCCGGTTCTGAAACCCCAGGTACCTCTG | EGTSESATPESGP | | |
| | AAAAGCGCTACTCCGGAGTCTGGCCCAGGTACCTCTACTG | GSEPATSGSETPG | | |
| | AACCGTCTGAGGGTAGCGCTCCAGGTACTTCTACTGAACC | TSESATPESGPGT | | |
| | GTCCGAAGGTAGCGCACCAGGTACTTCTACCGAACCGTC | STEPSEGSAPGTS | | |
| | CGAAGGCAGCGCTCCAGGTACCTCTACTGAACCTTCCGA | TEPSEGSAPGTST | | |
| | GGGCAGCGCTCCAGGTACCTCTACCGAACCTTCTGAAGG | EPSEGSAPGTSTE | | |
| | TAGCGCACCAGGTACTTCTACCGAACCGTCCGAGGGTAG | PSEGSAPGTSTEP | | |
| | CGCACCAGGTAGCCCAGCAGGTTCTCCTACCTCCACCGA | SEGSAPGTSTEPS | | |
| | GGAAGGTACTTCTACCGAACCGTCCGAGGGTAGCGCACC | EGSAPGSPAGSPT | | |
| | AGGTACCTCTGAAAGCGCAACTCCTGAGTCTGGCCCAGG | STEEGTSTEPSEG | | |
| | TAGCGAACCTGCTACCTCCGGCTCTGAGACTCCAGGTACC | SAPGTSESATPES | | |
| | TCTGAAAGCGCAACCCCGGAATCTGGTCCAGGTAGCGAA | GPGSEPATSGSET | | |
| | CCTGCAACCTCTGGCTCTGAAACCCCAGGTACCTCTGAAA | PGTSESATPESGP | | |
| | GCGCTACTCCTGAATCTGGCCCAGGTACTTCTACTGAACC | GSEPATSGSETPG | | |
| | GTCCGAGGGCAGCGCACCAGGTACTTCTGAAAGCGCTAC | TSESATPESGPGT | | |
| | TCCTGAGTCCGGCCCAGGTAGCCCGGCTGGCTCTCCGACT | STEPSEGSAPGTS | | |
| | TCCACCGAGGAAGGTAGCCCGGCTGGCTCTCCAACTTCTA | ESATPESGPGSPA | | |
| | CTGAAGAAGGTAGCCCGGCAGGCTCTCCGACCTCTACTG | GSPTSTEEGSPAG | | |
| | AGGAAGGTACTTCTGAAAGCGCAACCCCGGAGTCCGGCC | SPTSTEEGSPAGS | | |
| | CAGGTACCTCTACCGAACCGTCTGAGGGCAGCGCACCAG | PTSTEEGTSESAT | | |
| | GTGGTAGCCCGGCTGGCTCTTGTACCTCTCCAGGTACCTC | PESGPGTSTEPSE | | |
| | TGAAAGCGCAACTCCTGAGTCTGGCCCAGGTAGCGAACC | GSAPGGSPAGSC | | |
| | TGCTACCTCCGGCTCTGAGACTCCAGGTACCTCTGAAAGC | TSPGTSESATPES | | |
| | GCAACCCCGGAATCTGGTCCAGGTAGCGAACCTGCAACC | GPGSEPATSGSET | | |
| | TCTGGCTCTGAAACCCCAGGTACCTCTGAAAGCGCTACTC | PGTSESATPESGP | | |
| | CTGAATCTGGCCCAGGTACTTCTACTGAACCGTCCGAGGG | GSEPATSGSETPG | | |
| | CAGCGCACCAGGTAGCCCTGCTGGCTCTCCAACCTCCACC | TSESATPESGPGT | | |
| | GAAGAAGGTACCTCTGAAAGCGCAACCCCTGAATCCGGC | STEPSEGSAPGSP | | |
| | CCAGGTAGCGAACCGGCAACCTCCGGTTCTGAAACCCCA | AGSPTSTEEGTSE | | |
| | GGTACTTCTGAAAGCGCTACTCCTGAGTCCGGCCCAGGTA | SATPESGPGSEPA | | |
| | GCCCGGCTGGCTCTCCGACTTCCACCGAGGAAGGTAGCC | TSGSETPGTSESA | | |
| | CGGCTGGCTCTCCAACTTCTACTGAAGAAGGTACTTCTAC | TPESGPGSPAGSP | | |
| | CGAACCTTCCGAGGGCAGCGCACCAGGTACTTCTGAAAG | TSTEEGSPAGSPT | | |
| | CGCTACCCCTGAGTCCGGCCCAGGTACTTCTGAAAGCGCT | STEEGTSTEPSEG | | |
| | ACTCCTGAATCCGGTCCAGGTACTTCTGAAAGCGCTACCC | SAPGTSESATPES | | |
| | CGGAATCTGGCCCAGGTAGCGAACCGGCTACTTCTGGTTC | GPGTSESATPESG | | |
| | TGAAACCCCAGGTAGCGAACCGGCTACCTCCGGTTCTGA | PGTSESATPESGP | | |
| | AACTCCAGGTAGCCCAGCAGGCTCTCCGACTTCCACTGA | GSEPATSGSETPG | | |
| | GGAAGGTACTTCTACTGAACCTTCCGAAGGCAGCGCACC | SEPATSGSETPGS | | |
| | AGGTACCTCTACTGAACCTTCTGAGGGCAGCGCTCCAGGT | PAGSPTSTEEGTS | | |
| | AGCGAACCTGCAACCTCTGGCTCTGAAACCCCAGGTACC | TEPSEGSAPGTST | | |
| | TCTGAAAGCGCTACTCCTGAATCTGGCCCAGGTACTTCTA | EPSEGSAPGSEPA | | |

TABLE 38-continued

DNA and amino acid sequence of Cys-engineered XTEN

| Clone Name | DNA Sequence | SEQ ID NO: | Amino Acid Sequence | SEQ ID NO: |
|---|---|---|---|---|
| | CTGAACCGTCCGAGGGCAGCGCACCAGGTTAA | | TSGSETPGTSESA TPESGPGTSTEPS EGSAPG | |

Example 62

Purification of CBD-XTEN-Cys

E. coli containing AC292 on a plasmid were grown to saturation overnight in 2xYT and then 200 ml of this culture was used to inoculate a 25 L culture of 2xYT media in a wavebag. Both cultures were in the presence of 50 µg/ml kanamycin. The second culture was grown to an OD600 of ~1.0 at 37° C., chilled to 26° C., and induced with 12 ml of 1M IPTG overnight. The cell pellet was harvested at 4000 rpm in a SLA-3000 rotor spinning for 20 minutes. The cell pellet (184 g) was resuspended in 736 ml of 20 mM Tris pH 6.8, 50 mM NaCl. The resuspended cells were lysed with a microfluidizer at 20,000 psi and then heated to 75° C. for 15 minutes, followed by rapid cooling on ice for 30 minutes. The lysate was then clarified by centrifugation. The clarified lysate was then loaded on to a DE52 column, previously sanitized with NaOH and equilibrated with 20 mM Tris pH 6.8, 50 mM NaCl. The column was washed with 5 column volumes of 20 mM Tris pH 6.8, 50 mM NaCl, 5 column volumes of 20 mM Tris pH 6.8, 150 mM NaCl and eluted with 5 column volumes of 20 mM Tris pH 6.8, 250 mM NaCl. The pooled elution fractions. were then loaded on to a macrocapQ column, previously sanitized with NaOH and equilibrated with 20 mM Tris pH 6.8, 50 mM NaCl. The column was washed with 9 column volumes of 20 mM Tris pH 6.8, 50 mM NaCl, 9 column volumes of 20 mM Tris pH 6.8, 100 mM NaCl and eluted with 9 column volumes of 20 mM Tris pH 6.8, 250 mM NaCl. The pooled elution fractions were adjusted to a 15% w/v sodium sulfate and then loaded on to a octyl sepharose FF column column, previously sanitized with NaOH and equilibrated with Tris pH 7.5. The column was washed with 4 column volumes of 20 mM Tris pH 7.5 15% w/v sodium sulfate, and eluted with 4 column volumes of 20 mM Tris pH 7.5, 5% w/v sodium sulfate. The sample was stored at 4° C. and given the lot # AP197. The purified cysteine-engineered XTEN could then serve as a suitable reactant for conjugation with a drug, such as a drug from Table 5, resulting in an XTEN-drug conjugate.

Example 63

Conjugation and Purification of FITC-X-XTEN

Figure 42A:
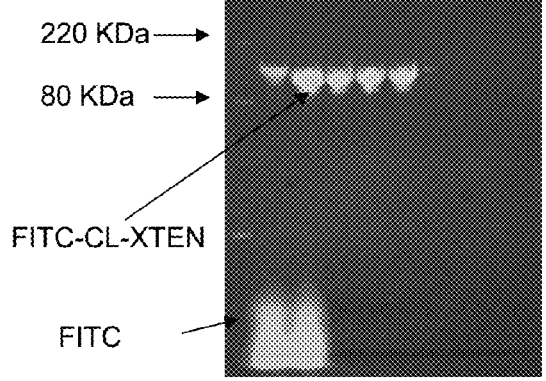
FIG. 42A shows the co-migration in a gel imaged by UV light box to show the large apparent MW of FITC-containing conjugated species, also detected by SEC at OD214 (protein signal) and OD495 (FITC signal) in a SEC column, indicating successful labeling of the XTEN with minimal free dye contamination. The materials by lane (left to right, after the MW standards are: labeled FITC-CL-CBD-XTEN; labeled FITC-CL-XTEN; purified FITC-CL-XTEN; purified FITC-CL-XTEN; and purified FITC-CL-XTEN. The gel was imaged by UV light box to show FITC apparent MW of FITC containing species.
Figure 42B:
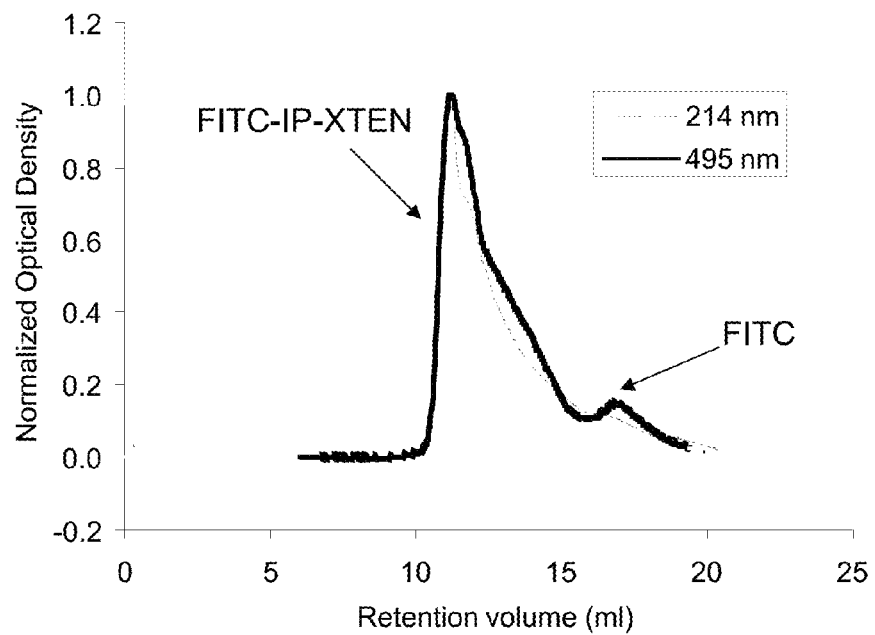
FIG. 42B shows the results of SEC analysis of FITC-conjugated XTEN, showing the overlap of the output of materials detected at OD214 and OD495, and also the apparent large molecular weight.

Purified protein derived from AC272, lot # AP197, was labeled with FITC maleimide. The sample was reduced by incubating at room temperature with 5 mM TCEP for 1 hour. The sample was then desalted into PBS using DG-10 columns. The sample was labeled by adding a 25-fold molar excess of FITC-maleimide in DMSO and incubating at room temperature for 2 hours. Note that the volume adjusted such that the DMSO concentration was <5% of total solvent. The reaction was quenched by adding 2 mM DTT and then the sample was digested overnight with TEV protease. The sample was diluted two fold with 20 mM Tris pH 7.5 and loaded onto a macrocapQ column, previously sanitized with NaOH and equilibrated with 20 mM Tris pH 7.5. The column was washed with 5 column volumes of 20 mM Tris pH 7.5, 135 mM NaCl, 5 column volumes of 20 mM Tris pH 7.5, 175 mM NaCl and eluted with 5 column volumes of 20 mM Tris pH 7.5, 250 mM NaCl. The pooled elution fractions were then digested with TEV over 60 hours at 4 C to complete the digestion. The digested samples were then twice passed over a 1 ml perloza column previously sanitized with NaOH and equilibrated with 20 mM Tris pH 7.5, 135 mM NaCl. To remove any free FITC the sample was then dialyzed against 20 mM Tris pH 7.5, 135 mM NaCl using a 10,000 MWCO membrane. Co-migration of the OD214 protein signal and OD495 FITC signal in a SEC column indicate successful conjugation of the XTEN with the label, with minimal free dye contamination (FIG. 42B). The successful conjugation is also indicated by apparent large MW of the protein with FITC fluorescence in SDS PAGE (FIG. 42A).

Example 64

Purification of GFP-X-XTEN

Figure 43:
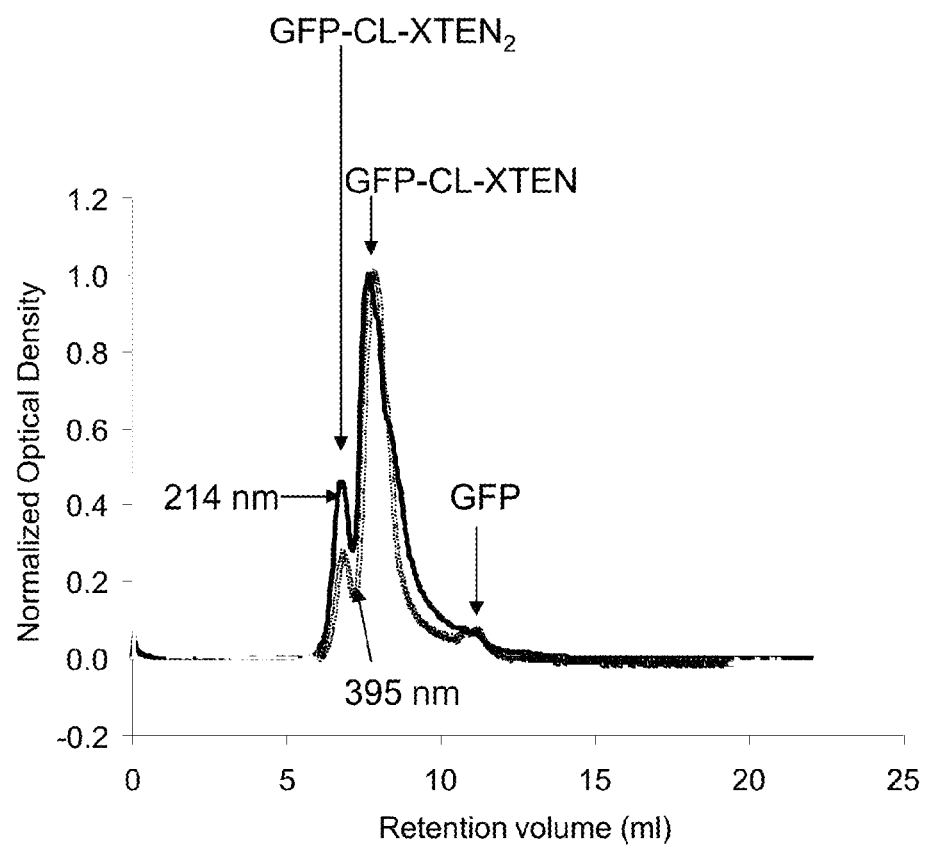
FIG. 43 shows results of SEC analyses of the peak elution fractions of conjugates of GFP cross-linked to XTEN and free GFP, as described in Example 64. Cross-linking was confirmed by co-migration of the OD214 protein signal and OD395 GFP signal in the SEC column.

GFP (AC219) was chemically cross-linked to XTEN by a bifunctional cross-linker with an amine reactive group to couple to the GFP lysines and a cysteine reactive group to couple to the free cysteine engineered into the XTEN in AC292. GFP was labeled with bi-functional cross linker sulfo-SMCC by incubating at room temperature for 2 hours. The protein was desalted into PBS using DG-10 columns to remove free sulfo-SMCC. Purified protein derived from AC272, lot # AP197 was reduced and desalted into PBS on DG-10 columns and mixed with the labeled GFP to allow for crosslinking. The crosslinking reaction was quenched with 2 mM DTT and TEV added to remove the CBD domain in a overnight incubation at 4° C. The following day additional TEV was added to complete the digestion with an additional 60 hour 4° C. incubation. Following TEV digestion the sample was dilute to 100 ml in 20 mM Tris pH 7.5 and loaded onto a macrocapQ column, previously sanitized with NaOH and equilibrated with 20 mM Tris pH 7.5. The column was washed with 5 column volumes of 20 mM Tris pH 7.5, 5 column volumes of 20 mM Tris pH 7.5, 50 mM NaCl, 5 column volumes of 20 mM Tris pH 7.5, 100 mM NaCl, 5 column volumes of 20 mM Tris pH 7.5, 150 mM NaCl, 5 column volumes of 20 mM Tris pH 7.5, 200 mM NaCl, 5 column volumes of 20 mM Tris pH 7.5, 250 mM NaCl, 5 column volumes of 20 mM Tris pH 7.5, 300 mM NaCl, and 5 column volumes of 20 mM Tris pH 7.5, 500 mM NaCl. The peak elution fractions were pooled and stored at 4° C. Crosslinking was confirm by co-migration of the OD214 protein signal and OD395 GFP signal in a SEC column, with the SEC output shown as overlays in FIG. 43.

Example 65

Pharmacokinetics of GFP-XTEN and FITC-XTEN Conjugates

Figure 44:
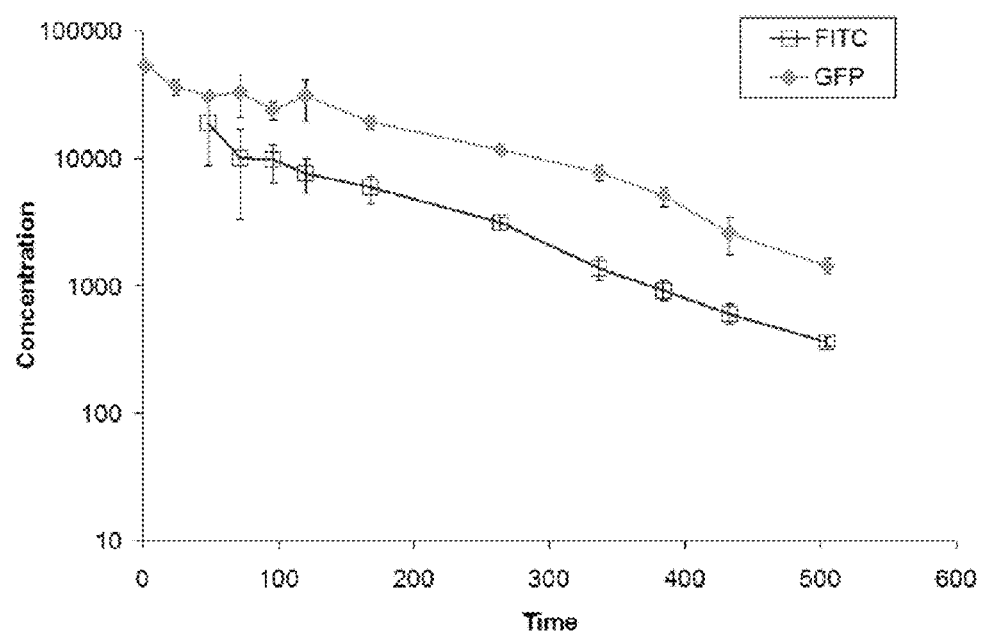
FIG. 44 shows the results of pharmacokinetic assays of GFP—X-XTEN and FITC-X-XTEN tested in cynomolgus monkeys, as described in Example 65.

The pharmacokinetics of the GFP-XTEN and FITC-XTEN cross-linked conjugates prepared as described in the Examples above were tested in cynomolgus monkeys. GFP-XTEN and FITC-XTEN were administered to male cynos IV at 2 mg/kg and dose volumes of 0.77 and 0.68 mL respectively. Blood samples (1.0 mL) were collected into prechilled heparinized tubes at predose, 2, 4, 8, 24, 48, 72, 96, 120, 168, 216, 264, 336, 388, 432, 504 hour time points, and processed into plasma. Quantitation was performed by ELISA assay using the anti-XTEN antibody for both capture and detection in the case of GFP-XTEN and anti-XTEN capture and anti-FITC detection in the case of FITC-XTEN. A non-compartmental analysis was performed in WinNonLin with all time points included in the fit to determine the PK parameters. The pharmacokinetic results are summarized in Table 39 and FIG. 44. The data show XTEN can extend the half-life of molecules to which it is chemically conjugated in a manner comparable to genetic fusions to payloads of similar size.

TABLE 39

PK parameters:

| Construct | Cmax (ng/mL) | AUC (hr*ng/mL) | T ½ (hrs) |
|---|---|---|---|
| GFP-X-XTEN (AP197d) | 52800 | 8220000 | 107 |
| FITC-X-XTEN AP197e | 18900 | 3930000 | 84.2 |

Example 66

Preparation of Anti-Her2-XTEN-Paclitaxel BFP-D Conjugate

The conjugation process that can be employed is generically illustrated in FIG. 45. Drugs can be conjugated to XTEN using the methods of the disclosure or those, e.g., of US Patent publication No. 2009/0074704. By the methods, paclitaxel can first be reacted with an activated linker to a suitable functional group, as shown in FIG. 45. The resulting conjugate can be purified by suitable, standard methods known in the art, including HPLC, size exclusion chromatography, gel filtration, ion exchange chromatography, or combinations thereof. Subsequently, the activated paclitaxel conjugate would be incubated with aHer2-XTEN-Cys that was expressed and purified as described in Example 24, using at least a 25-fold excess of paclitaxel conjugate to ensure all reactive cysteine sites on the XTEN are conjugated. The conjugation could be performed essentially as described in Example 64. Excess paclicaxel would be removed from the reaction mixture by dialysis and the final purified product would be concentrated and stored for subsequent use.

Example 67

Clinical Applications of Anti-Her2-XTEN-Pactlitaxel Compositions

Her2 antigen is overexpressed on a large number of solid malignancies. Expression is particularly high on many breast cancer cells. Herceptin has been approved for the treatment of Her2-positive breast cancers. The invention contemplates that anti-Her2-XTEN-paclitaxel can be used for the treatment of the same patient population. Clinical trials can be designed such that the efficacy and advantages of the anti-Her2-XTEN-paclitaxel compositions can be verified in humans. Such studies in patients would comprise three phases. First, a Phase I safety and pharmacokinetics study in adult patients would be conducted to determine the maximum tolerated dose and pharmacokinetics and pharmacodynamics in humans. These studies define potential toxicities and adverse events to be tracked in future studies. The scheme of the study would be to use single escalating doses of aHer2-XTEN-paclitaxel compositions and measure the biochemical, PK, and clinical parameters. This would permit the determination of the maximum tolerated dose and establish the threshold and maximum concentrations in dosage and circulating drug that constitute the therapeutic window to be used in subsequent Phase II and Phase III trials trials conducted in target indications to determine efficacy and tolerability of the aHER2-XTEN-paclitaxel compositions.

TABLE 40

Binding fusion proteins with targeting moieties to single targets

| Name* | Protein Sequence | SEQ ID NO: |
|---|---|---|
| CTLA4_4-AM875 | MHVAQPAVVLASSRGIASFVCEYASPGKATEVRVTVLRQADSQVTEVCAATYMM GNELTFLDDSICTGTSSGNQVNLTIQGLRAMDTGLYICKVELMYPPPYYLGIGNGTQ IYVIDPEGGTSTEPSEGSAPGSEPATSGSETPGSPAGSPTSTEEGSTSSTAESPGPGTST PESGSASPGSTSESPSGTAPGSTSESPSGTAPGTSTPESGSASPGTSTPESGSASPGSEP ATSGSETPGTSESATPESGPGSPAGSPTSTEEGTSTEPSEGSAPGTSESATPESGPGTST EPSEGSAPGTSTEPSEGSAPGSPAGSPTSTEEGTSTEPSEGSAPGTSTEPSEGSAPGTSE SATPESGPGTSESATPESGPGTSTEPSEGSAPGTSTEPSEGSAPGTSESATPESGPGTST EPSEGSAPGSEPATSGSETPGSPAGSPTSTEEGSSTPSGATGSPGTPGSGTASSSPGSST PSGATGSPGTSTEPSEGSAPGTSTEPSEGSAPGSEPATSGSETPGSPAGSPTSTEEGSPA GSPTSTEEGTSTEPSEGSAPGASASGAPSTGGTSESATPESGPGSPAGSPTSTEEGSPA GSPTSTEEGSTSSTAESPGPGSTSESPSGTAPGTSPSGESSTAPGTPGSGTASSSPGSST PSGATGSPGSSPASTGTGPGSEPATSGSETPGTSESATPESGPGSEPATSGSETPGSTS STAESPGPGSTSSTAESPGPGTSPSGESSTAPGSEPATSGSETPGSEPATSGSETPGTST EPSEGSAPGSTSSTAESPGPGTSTPESGSASPGSTSESPSGTAPGTSTEPSEGSAPGTST EPSEGSAPGTSTEPSEGSAPGSSTPSGATGSPGSSPSASTGTGPGASPGTSSTGSPGSEP ATSGSETPGTSESATPESGPGSPAGSPTSTEEGSSTPSGATGSPGSSPSASTGTGPGAS PGTSSTGSPGTSESATPESGPGTSTEPSEGSAPGTSTEPSEGSAP | 802 |
| AE912-CTLA4 | MAEPAGSPTSTEEGTPGSGTASSSPGSSTPSGATGSPGASPGTSSTGSPGSPAGSPTST EEGTSESATPESGPGTSTEPSEGSAPGSPAGSPTSTEEGTSTEPSEGSAPGTSTEPSEGS | 803 |

TABLE 40-continued

Binding fusion proteins with targeting moieties to single targets

| Name* | Protein Sequence | SEQ ID NO: |
|---|---|---|
| | APGTSESATPESGPGSEPATSGSETPGSEPATSGSETPGSPAGSPTSTEEGTSESATPES<br>GPGTSTEPSEGSAPGTSTEPSEGSAPGSPAGSPTSTEEGTSTEPSEGSAPGTSTEPSEGS<br>APGTSESATPESGPGTSTEPSEGSAPGTSESATPESGPGSEPATSGSETPGTSTEPSEGS<br>APGTSTEPSEGSAPGTSESATPESGPGTSESATPESGPGSPAGSPTSTEEGTSESATPES<br>GPGSEPATSGSETPGTSESATPESGPGTSTEPSEGSAPGTSTEPSEGSAPGTSTEPSEGS<br>APGTSTEPSEGSAPGTSTEPSEGSAPGTSTEPSEGSAPGSPAGSPTSTEEGTSTEPSEGS<br>APGTSESATPESGPGSEPATSGSETPGTSESATPESGPGSEPATSGSETPTSESATPES<br>GPGTSTEPSEGSAPGTSESATPESGPGSPAGSPTSTEEGSPAGSPTSTEEGSPAGSPTST<br>EEGTSESATPESGPGTSTEPSEGSAPGTSESATPESGPGSEPATSGSETPGTSESATPES<br>GPGSEPATSGSETPGTSESATPESGPGTSTEPSEGSAPGSPAGSPTSTEEGTSESATPES<br>GPGSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSGSE<br>TPGSPAGSPTSTEEGTSTEPSEGSAPGTSTEPSEGSAPGSEPATSGSETPGTSESATPES<br>GPGTSTEPSEGSAPGMHVAQPAVVLASSRGIASFVCEYASPGKATEVRVTVLRQAD<br>SQVTEVCAATYMMGNELTFLDDSICTGTSSGNQVNLTIQGLRAMDTGLYICKVELM<br>YPPPYYLGIGNGTQIYVIDPEG | |
| CTLA4-<br>AE36-<br>CTLA4-<br>AE864 | MAMHVAQPAVVLASSRGIASFVCEYASPGKATEVRVTVLRQADSQVTEVCAATY<br>MMGNELTFLDDSICTGTSSGNQVNLTIQGLRAMDTGLYICKVELMYPPPYYLGIGN<br>GTQIYVIDPEGAPGTSESATPESGPGSEPATSGSETPGTSTEPSEGSAPGPAMHVAQP<br>AVVLASSRGIASFVCEYASPGKATEVRVTVLRQADSQVTEVCAATYMMGNELTFL<br>DDSICTGTSSGNQVNLTIQGLRAMDTGLYICKVELMYPPPYYLGIGNGTQIYVIDPE<br>GGSPAGSPTSTEEGTSESATPESGPGTSTEPSEGSAPGSPAGSPTSTEEGTSTEPSEGSA<br>PGTSTEPSEGSAPGTSESATPESGPGSEPATSGSETPGSEPATSGSETPGSPAGSPTSTE<br>EGTSESATPESGPGTSTEPSEGSAPGTSTEPSEGSAPGSPAGSPTSTEEGTSTEPSEGSA<br>PGTSTEPSEGSAPGTSESATPESGPGTSTEPSEGSAPGTSESATPESGPGSEPATSGSET<br>PGTSTEPSEGSAPGTSTEPSEGSAPGTSESATPESGPGSPAGSPTSTE<br>EGTSESATPESGPGSEPATSGSETPGTSESATPESGPGTSTEPSEGSAPGTSTEPSEGSA<br>PGTSTEPSEGSAPGTSTEPSEGSAPGTSTEPSEGSAPGTSTEPSEGSAPGSPAGSPTSTE<br>EGTSTEPSEGSAPGTSESATPESGPGSEPATSGSETPGTSESATPESGPGSEPATSGSET<br>PGTSESATPESGPGTSTEPSEGSAPGTSESATPESGPGSPAGSPTSTEEGSPAGSPTSTE<br>EGSPAGSPTSTEEGTSESATPESGPGTSTEPSEGSAPGTSESATPESGPGSEPATSGSET<br>PGTSESATPESGPGSEPATSGSETPGTSESATPESGPGTSTEPSEGSAPGSPAGSPTSTE<br>EGTSESATPESGPGSEPATSGSETPGTSESATPESGPGSPAGSPTSTEEGSPAGSPTSTE<br>EGTSTEPSEGSAPGTSESATPESGPGTSESATPESGPGTSESATPESGPGSEPATSGSET<br>PGSEPATSGSETPGSPAGSPTSTEEGTSTEPSEGSAPGTSTEPSEGSAPGSEPATSGSET<br>PGTSESATPESGPGTSTEPSEGSAPG | 804 |
| CTLA4-<br>AE158-<br>CTLA4-<br>AE864 | MAMHVAQPAVVLASSRGIASFVCEYASPGKATEVRVTVLRQADSQVTEVC TABLE 40-continued Binding fusion proteins with targeting moieties to single targets

| Name* | Protein Sequence | SEQ ID NO: |
|---|---|---|
| | TSESATPESGPGSEPATSGSETPGTSESATPESGPGTSTEPSEGSAPGTSTEPSEGSAPG<br>TSTEPSEGSAPGTSTEPSEGSAPGTSTEPSEGSAPGTSTEPSEGSAPGSPAGSPTSTEEG<br>TSTEPSEGSAPGTSESATPESGPGSEPATSGSETPGTSESATPESGPGSEPATSGSETPG<br>TSESATPESGPGTSTEPSEGSAPGTSESATPESGPGSPAGSPTSTEEGSPAGSPTSTEEG<br>SPAGSPTSTEEGTSESATPESGPGTSTEPSEGSAPGTSESATPESGPGSEPATSGSETPG<br>TSESATPESGPGSEPATSGSETPGTSESATPESGPGTSTEPSEGSAPGSPAGSPTSTEEG<br>TSESATPESGPGSEPATSGSETPGTSESATPESGPGSPAGSPTSTEEGSPAGSPTSTEEG<br>TSTEPSEGSAPGTSESATPESGPGTSESATPESGPGTSESATPESGPGSEPATSGSETPG<br>SEPATSGSETPGSPAGSPTSTEEGTSTEPSEGSAPGTSTEPSEGSAPGSEPATSGSETPG<br>TSESATPESGPGTSTEPSEGSAPG | |
| AE912-<br>aIL6R | MAEPAGSPTSTEEGTPGSGTASSSPGSSTPSGATGSPGASPGTSSTGSPGSPAGSPTST<br>EEGTSESATPESGPGTSTEPSEGSAPGSPAGSPTSTEEGTSTEPSEGSAPGTSTEPSEGS<br>APGTSESATPESGPGSEPATSGSETPGSEPATSGSETPGSPAGSPTSTEEGTSESATPES<br>GPGTSTEPSEGSAPGTSTEPSEGSAPGSPAGSPTSTEEGTSESATPESGPGTSTEPSEGS<br>APGTSESATPESGPGTSTEPSEGSAPGTSESATPESGPGSEPATSGSETPGTSTEPSEGS<br>APGTSTEPSEGSAPGTSESATPESGPGTSESATPESGPGSPAGSPTSTEEGTSESATPES<br>GPGSEPATSGSETPGTSESATPESGPGTSTEPSEGSAPGTSTEPSEGSAPGTSTEPSEGS<br>APGTSTEPSEGSAPGTSTEPSEGSAPGTSTEPSEGSAPGSPAGSPTSTEEGTSTEPSEGS<br>APGTSESATPESGPGSEPATSGSETPGTSESATPESGPGSEPATSGSETPGTSESATPES<br>GPGTSTEPSEGSAPGTSESATPESGPGSPAGSPTSTEEGSPAGSPTSTEEGSPAGSPTST<br>EEGTSESATPESGPGTSTEPSEGSAPGTSESATPESGPGSEPATSGSETPGTSESATPES<br>GPGSEPATSGSETPGTSESATPESGPGTSTEPSEGSAPGSPAGSPTSTEEGTSESATPES<br>GPGSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSGSE<br>TPGSPAGSPTSTEEGTSTEPSEGSAPGTSTEPSEGSAPGSEPATSGSETPGTSESATPES<br>GPGTSTEPSEGSAPGADIQMTQSPSSLSASVGDRVTITCRASQDISSYLNWYQQKPG<br>KAPKLLIYYTSRLHSGVPSRFSGSGSGTDFTFTISSLQPEDIATYYCQQGNTLPYTFG<br>QGTKVEIKTGSGEGSEGEGGGEGSEGEGSGEGGEGEGSGSQVQLQESGPGLVRPSQ<br>TLSLTCTVSGYSITSDHAWSWVRQPPGRGLEWIGYISYSGITTYNPSLKSRVTMLRD<br>TSKNQFSLRLSSVTAADTAVYYCARSLARTTAMDYWGQGSLVTVSS | 807 |
| aIL6R-<br>AE864 | MADIQMTQSPSSLSASVGDRVTITCRASQDISSYLNWYQQKPGKAPKLLIYYTSRLH<br>SGVPSRFSGSGSGTDFTFTISSLQPEDIATYYCQQGNTLPYTFGQGTKVEIKTGSGEG<br>SEGEGGGEGSEGEGSGEGGEGEGSGSQVQLQESGPGLVRPSQTLSLTCTVSGYSITS<br>DHAWSWVRQPPGRGLEWIGYISYSGITTYNPSLKSRVTMLRDTSKNQFSLRLSSVTA<br>ADTAVYYCARSLARTTAMDYWGQGSLVTVSSGSPGSPAGSPTSTEEGTSESATPESES<br>GPGTSTEPSEGSAPGSPAGSPTSTEEGTSTEPSEGSAPGTSTEPSEGSAPGTSESATPES<br>GPGSEPATSGSETPGSEPATSGSETPGSPAGSPTSTEEGTSESATPESGPGTSTEPSEGS<br>APGTSTEPSEGSAPGSPAGSPTSTEEGTSTEPSEGSAPGTSESATPESGPGTSESATPES<br>GPGTSTEPSEGSAPGTSESATPESGPGSEPATSGSETPGTSTEPSEGSAPGTSTEPSEGS<br>APGTSESATPESGPGTSESATPESGPGSPAGSPTSTEEGTSESATPESGPGSEPATSGSE<br>TPGTSESATPESGPGTSTEPSEGSAPGTSTEPSEGSAPGTSTEPSEGSAPGTSTEPSEGS<br>APGTSTEPSEGSAPGTSTEPSEGSAPGSPAGSPTSTEEGTSTEPSEGSAPGTSESATPES<br>GPGSEPATSGSETPGTSESATPESGPGSEPATSGSETPGTSESATPESGPGTSTEPSEGS<br>APGTSESATPESGPGSPAGSPTSTEEGSPAGSPTSTEEGSPAGSPTSTEEGTSESATPES<br>GPGTSTEPSEGSAPGTSESATPESGPGSEPATSGSETPGTSESATPESGPGSEPATSGSE<br>TPGTSESATPESGPGTSTEPSEGSAPGSPAGSPTSTEEGTSESATPESGPGSEPATSGSE<br>TPGTSESATPESGPGSPAGSPTSTEEGSPAGSPTSTEEGTSTEPSEGSAPGTSESATPES<br>GPGTSESATPESGPGTSESATPESGPGSEPATSGSETPGSEPATSGSETPGSPAGSPTST<br>EEGTSTEPSEGSAPGTSTEPSEGSAPGSEPATSGSETPGTSESATPESGPGTSTEPSEGS<br>APG | 808 |
| AE912-<br>aIL6R-<br>AE144 | MAEPAGSPTSTEEGTPGSGTASSSPGSSTPSGATGSPGASPGTSSTGSPGSPAGSPTST<br>EEGTSESATPESGPGTSTEPSEGSAPGSPAGSPTSTEEGTSTEPSEGSAPGTSTEPSEGS<br>APGTSESATPESGPGSEPATSGSETPGSEPATSGSETPGSPAGSPTSTEEGTSESATPES<br>GPGTSTEPSEGSAPGTSTEPSEGSAPGSPAGSPTSTEEGTSTEPSEGSAPGTSTEPSEGS<br>APGTSESATPESGPGTSTEPSEGSAPGTSESATPESGPGSEPATSGSETPGTSTEPSEGS<br>APGTSTEPSEGSAPGTSESATPESGPGTSESATPESGPGSPAGSPTSTEEGTSESATPES<br>GPGSEPATSGSETPGTSESATPESGPGTSTEPSEGSAPGTSTEPSEGSAPGTSTEPSEGS<br>APGTSTEPSEGSAPGTSTEPSEGSAPGTSTEPSEGSAPGSPAGSPTSTEEGTSTEPSEGS<br>APGTSESATPESGPGSEPATSGSETPGTSESATPESGPGSEPATSGSETPGTSESATPES<br>GPGTSTEPSEGSAPGTSESATPESGPGSPAGSPTSTEEGSPAGSPTSTEEGSPAGSPTST<br>EEGTSESATPESGPGTSTEPSEGSAPGTSESATPESGPGSEPATSGSETPGTSESATPES<br>GPGSEPATSGSETPGTSESATPESGPGTSTEPSEGSAPGSPAGSPTSTEEGTSESATPES<br>GPGSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSGSE<br>TPGSPAGSPTSTEEGTSTEPSEGSAPGTSTEPSEGSAPGSEPATSGSETPGTSESATPES<br>GPGTSTEPSEGSAPGADIQMTQSPSSLSASVGDRVTITCRASQDISSYLNWYQQKPG<br>KAPKLLIYYTSRLHSGVPSRFSGSGSGTDFTFTISSLQPEDIATYYCQQGNTLPYTFG<br>QGTKVEIKTGSGEGSEGEGGGEGSEGEGSGEGGEGEGSGSQVQLQESGPGLVRPSQ<br>TLSLTCTVSGYSITSDHAWSWVRQPPGRGLEWIGYISYSGITTYNPSLKSRVTMLRD | 809 |

TABLE 40-continued

Binding fusion proteins with targeting moieties to single targets

| Name* | Protein Sequence | SEQ ID NO: |
|---|---|---|
| | TSKNQFSLRLSSVTAADTAVYYCARSLARTTAMDYWGQGSLVTVSSGGTSESATPE SGPGTSTEPSEGSAPGTSTEPSEGSAPGTSESATPESGPGTSTEPSEGSAPGTSTEPSEG SAPGTSESATPESGPGTSTEPSEGSAPGTSTEPSEGSAPGTSTEPSEGS | |
| AE48-aIL6R-AE864 | MAEPAGSPTSTEEGTPGSGTASSSPGSSTPSGATGSPGASPGTSSTGSPGSPGDIQMT QSPSSLSASVGDRVTITCRASQDISSYLNWYQQKPGKAPKLLIYYTSRLHSGVPSRFS GSGSGTDFTFTISSLQPEDIATYYCQQGNTLPYTFGQGTKVEIKTGSGEGSEGEGGGE GSEGEGSGEGGEGEGSGSQVQLQESGPGLVRPSQTLSLTCTVSGYSITSDHAWSWV RQPPGRGLEWIGYISYSGITTYNPSLKSRVTMLRDTSKNQFSLRLSSVTAADTAVYY CARSLARTTAMDYWGQGSLVTVSSGGSPAGSPTSTEEGTSESATPESGPGTSTEPSE GSAPGSPAGSPTSTEEGTSTEPSEGSAPGTSTEPSEGSAPGTSESATPESGPGSEPATS GSETPGSEPATSGSETPGSPAGSPTSTEEGTSESATPESGPGTSTEPSEGSAPGTSTEPS EGSAPGSPAGSPTSTEEGTSTEPSEGSAPGTSTEPSEGSAPGTSESATPESGPGTSTEPS EGSAPGTSESATPESGPGSPAGSPTSTEEGTSESATPESGPGSEPATSGSETPGTSESAT PESGPGTSTEPSEGSAPGTSTEPSEGSAPGTSTEPSEGSAPGTSTEPSEGSAPGTSTEPS EGSAPGTSTEPSEGSAPGSPAGSPTSTEEGTSTEPSEGSAPGTSESATPESGPGSEPATS GSETPGTSESATPESGPGSEPATSGSETPGTSESATPESGPGTSTEPSEGSAPGTSESAT PESGPGSPAGSPTSTEEGSPAGSPTSTEEGSPAGSPTSTEEGTSESATPESGPGTSTEPS EGSAPGTSESATPESGPGSEPATSGSETPGTSESATPESGPGSEPATSGSETPGTSESAT PESGPGTSTEPSEGSAPGSPAGSPTSTEEGTSESATPESGPGSEPATSGSETPGTSESAT PESGPGSPAGSPTSTEEGSPAGSPTSTEEGTSTEPSEGSAPGTSESATPESGPGTSESAT PESGPGTSESATPESGPGSEPATSGSETPGSEPATSGSETPGSPAGSPTSTEEGTSTEPS EGSAPGTSTEPSEGSAPGSEPATSGSETPGTSESATPESGPGTSTEPSEGSAPG | 810 |
| aIL6R_VL-AF144-aIL6R_VH-AM875 | DIQMTQSPSSLSASVGDRVTITCRASQDISSYLNWYQQKPGKAPKLLIYYTSRLHSG VPSRFSGSGSGTDFTFTISSLQPEDIATYYCQQGNTLPYTFGQGTKVEIKGGTSTPESG SASPGTSPSGESSTAPGTSPSGESSTAPGTSAESPGPGSTSESPSGTAPGSTSSTAE SPGPGTSPSGESSTAPGTSTPESGSASPGTSSTAESPGPGTSPSGESSTAPGTSPSGES STAPGTSPSGESSTAPGQVQLQESGPGLVRPSQTLSLTCTVSGYSITSDHAWSWVRQ PPGRGLEWIGYISYSGITTYNPSLKSRVTMLRDTSKNQFSLRLSSVTAADTAVYYCA RSLARTTAMDYWGQGSLVTVSSGGTSTEPSEGSAPGSEPATSGSETPGSPAGSPTST EEGSTSSTAESPGPGTSTPESGSASPGTSSESPSGTAPGSTSESPSGTAPGTSTPESGSA SPGTSTPESGSASPGSEPATSGSETPGTSESATPESGPGSPAGSPTSTEEGTSTEPSEGS APGTSESATPESGPGTSTEPSEGSAPGTSTEPSEGSAPGSPAGSPTSTEEGTSTEPSEGS APGTSTEPSEGSAPGTSESATPESGPGTSESATPESGPGTSTEPSEGSAPGTSTEPSEGS APGTSESATPESGPGTSTEPSEGSAPGSEPATSGSETPGSPAGSPTSTEEGSSTPSGAT GSPGTPGSGTASSSPGSSTPSGATGSPGTSTEPSEGSAPGTSTEPSEGSAPGSEPATSGS ETPGSPAGSPTSTEEGSPAGSPTSTEEGTSTEPSEGSAPGASASGAPSTGGTSESATPE SGPGSPAGSPTSTEEGSPAGSPTSTEEGTSSTAESPGPGSTSESPSGTAPGTSPSGESS TAPGTPGSGTASSSPGSSTPSGATGSPGSSPSASTGTGPGSEPATSGSETPGTSESATP ESGPGSEPATSGSETPGTSSTAESPGPGSTSSTAESPGPGTSPSGESSTAPGSEPATSG SETPGSEPATSGSETPGTSTEPSEGSAPGSTSSTAESPGPGTSTPESGSASPGSTSESPS GTAPGTSTEPSEGSAPGTSTEPSEGSAPGTSTEPSEGSAPGSSTPSGATGSPGSSPSAST GTGPGASPGTSSTGSPGSEPATSGSETPGTSESATPESGPGSPAGSPTSTEEGSSTPSG ATGSPGSSPSASTGTGPGASPGTSSTGSPGTSESATPESGPGTSTEPSEGSAPGTSTEPS EGSAPG | 811 |
| AM923-aIL6R_VH-AF144-aIL6R_VL | MAEPAGSPTSTEEGASPGTSSTGSPGSSTPSGATGSPGSSTPSGATGSPGTSTEPSEGS APGSEPATSGSETPGSPAGSPTSTEEGSTSSTAESPGPGTSTPESGSASPGSTSESPSGT APGSTSESPSGTAPGTSTPESGSASPGTSTPESGSASPGSEPATSGSETPGTSESATPES GPGSPAGSPTSTEEGTSTEPSEGSAPGTSESATPESGPGTSTEPSEGSAPGTSTEPSEGS APGSPAGSPTSTEEGTSTEPSEGSAPGTSESATPESGPGTSESATPESGPGTSTEPSEGS APGTSTEPSEGSAPGTSESATPESGPGTSTEPSEGSAPGSEPATSGSE TPGSPAGSPTSTEEGSSTPSGATGSPGTPGSGTASSSPGSSTPSGATGSPGTSTEPSEGS APGTSTEPSEGSAPGSEPATSGSETPGSPAGSPTSTEEGSPAGSPTSTEEGTSTEPSEGS APGASASGAPSTGGTSESATPESGPGSPAGSPTSTEEGSPAGSPTSTEEGTSSTAESP GPGSTSESPSGTAPGTSPSGESSTAPGTPGSGTASSSPGSSTPSGATGSPGSSPSASTGT GPGSEPATSGSETPGTSESATPESGPGSEPATSGSETPGTSSTAESPGPGSTSSTAESP GPGTSPSGESSTAPGSEPATSGSETPGSEPATSGSETPGTSTEPSEGSAPGTSSTAESP GPGTSTPESGSASPGSTSESPSGTAPGTSTEPSEGSAPGTSTEPSEGSAPGTSTEPSEGS APGSSTPSGATGSPGSSPSASTGTGPGASPGTSSTGSPGSEPATSGSETPGTSESATPES GPGSPAGSPTSTEEGSSTPSGATGSPGSSPSASTGTGPGASPGTSSTGSPGTSESATPES GPGTSTEPSEGSAPGTSTEPSEGSAPGQVQLQESGPGLVRPSQTLSLTCTVSGYSITSD HAWSWVRQPPGRGLEWIGYISYSGITTYNPSLKSRVTMLRDTSKNQFSLRLSSVTAA DTAVYYCARSLARTTAMDYWGQGSLVTVSSGGTSTPESGSASPGTSPSGESSTAPG TSPSGESSTAPGTSSTAESPGPGTSESPSGTAPGSTSSTAESPGPGTSPSGESSTAPG TSTPESGSASPGTSSTAESPGPGTSPSGESSTAPGTSPSGESSTAPGTSPSGESSTAPG DIQMTQSPSSLSASVGDRVTITCRASQDISSYLNWYQQKPGKAPKLLIYYTSRLHSG VPSRFSGSGSGTDFTFTISSLQPEDIATYYCQQGNTLPYTFGQGTKVEIKG | 812 |
| aIL6R_VL-Linker_AE42-aIL6R_VH- | DIQMTQSPSSLSASVGDRVTITCRASQDISSYLNWYQQKPGKAPKLLIYYTSRLHSG VPSRFSGSGSGTDFTFTISSLQPEDIATYYCQQGNTLPYTFGQGTKVEIKGGAPGTSE SATPESGPGSEPATSGSETPGTSTEPSEGSAPGPAGQVQLQESGPGLVRPSQTLSLTC | 813 |

TABLE 40-continued

Binding fusion proteins with targeting moieties to single targets

| Name* | Protein Sequence | SEQ ID NO: |
|---|---|---|
| AD576 | TVSGYSITSDHAWSWVRQPPGRGLEWIGYISYSGITTYNPSLKSRVTMLRDTSKNQF<br>SLRLSSVTAADTAVYYCARSLARTTAMDYWGQGSLVTVSSGGSSESGSSEGGPGSG<br>GEPSESGSSGSSGSSESGSSEGGPGSSESGSSEGGPGSSESGSSEGGPGSSESGSSEGGPGSS<br>ESGSSEGGPGESPGGSSGSESGSEGSSGPGESSGSSESGSSEGGPGSSESGSSEGGPGS<br>SESGSSEGGPGSGGEPSESGSSGESPGGSSGSESGESPGGSSGSESGSGGEPSESGSSG<br>SSESGSSEGGPGSGGEPSESGSSGSGGEPSESGSSGSESGSSEGGPGESPGGSSGSES<br>GSGGEPSESGSSGSGGEPSESGSSGSGGEPSESGSSGSSESGSSEGGPGESPGGSSGSE<br>SGESPGGSSGSESGESPGGSSGSESGESPGGSSGSESGESPGGSSGSESGSSESGSSEG<br>GPGSGGEPSESGSSGSEGSSGPGESSGSSESGSSEGGPGSGGEPSESGSSGSSESGSSE<br>GGPGSGGEPSESGSSGESPGGSSGSESGESPGGSSGSESGSSESGSSEGGPGSGGEPSE<br>SGSSGSSESGSSEGGPGSGGEPSESGSSGSGGEPSESGSSGESPGGSSGSESGSEGSSG<br>PGESSGSSESGSSEGGPGSEGSSGPGESSG | |
| AM923-<br>aIL6R_VH-<br>Linker_AM150-<br>aIL6R_VH | MAEPAGSPTSTEEGASPGTSSTGSPGSSTPSGATGSPGSSTPSGATGSPGTSTEPSEGS<br>APGSEPATSGSETPGSPAGSPTSTEEGSTSSTAESPGPGTSTPESGSASPGSTSESPSGT<br>APGSTSESPSGTAPGTSTPESGSASPGTSTPESGSASPGSEPATSGSETPGTSESATPES<br>GPGSPAGSPTSTEEGSTSTEPSEGSAPGTSESATPESGPGTSTEPSEGSAPGTSTEPSEGS<br>APGSPAGSPTSTEEGSTSTEPSEGSAPGTSTEPSEGSAPGTSESATPESGPGTSESATPES<br>GPGTSTEPSEGSAPGTSTEPSEGSAPGTSESATPESGPGTSTEPSEGSAPGSEPATSGSE<br>TPGSPAGSPTSTEEGSSTPSGATGSPGTPGSGTASSSPGSSTPSGATGSPGTSTEPSEGS<br>APGTSTEPSEGSAPGSEPATSGSETPGSPAGSPTSTEEGSPAGSPTSTEEGTSTEPSEGS<br>APGASASGAPSTGGTSESATPESGPGSPAGSPTSTEEGSPAGSPTSTEEGSTSSTAESP<br>GPGSTSESPSGTAPGTSPSGESSTAPGTPGSGTASSSPGSSTPSGATGSPGSSPSASTGT<br>GPGSEPATSGSETPGTSESATPESGPGSEPATSGSETPGTSSTAESPGPGSTSSTAESP<br>GPGTSPSGESSTAPGSEPATSGSETPGSEPATSGSETPGTSTEPSEGSAPGSTSSTAESP<br>GPGTSTPESGSASPGSTSESPSGTAPGTSTEPSEGSAPGTSTEPSEGSAPGTSTEPSEGS<br>APGSSTPSGATGSPGSSPSASTGTGPGASPGTSSTGSPGSEPATSGSETPGTSESATPES<br>GPGSPAGSPTSTEEGSSTPSGATGSPGSSPSASTGTGPGASPGTSSTGSPGTSESATPES<br>GPGTSTEPSEGSAPGTSTEPSEGSAPGQVQLQESGPGLVRPSQTLSLTCTVSGYSITSD<br>HAWSWVRQPPGRGLEWIGYISYSGITTYNPSLKSRVTMLRDTSKNQFSLRLSSVTAA<br>DTAVYYCARSLARTTAMDYWGQGSLVTVSSGGAPSTGGTSESATPESGPGTSTEPS<br>EGSAPGTSTEPSEGSAPGTSESATPESGPGTSTEPSEGSAPGTSTEPSEGSAPGTSESAT<br>PESGPGTSTEPSEGSAPGTSTEPSEGSAPGTSTEPSEGSAPGSPAGSPTSTEEGTSTEPS<br>EGSAPGPEPTGPAGQVQLQESGPGLVRPSQTLSLTCTVSGYSITSDHAWSWVRQPPG<br>RGLEWIGYISYSGITTYNPSLKSRVTMLRDTSKNQFSLRLSSVTAADTAVYYCARSL<br>ARTTAMDYWGQGSLVTVSSG | 814 |
| aIL6R_VL-<br>AE42-<br>aIL6R_VH-<br>AM875 | DIQMTQSPSSLSASVGDRVTITCRASQDISSYLNWYQQKPGKAPKLLIYYTSRLHSG<br>VPSRFSGSGSGTDFTFTISSLQPEDIATYYCQQGNTLPYTFGQGTKVEIKGGAPGTSE<br>SATPESGPGSEPATSGSETPGTSTEPSEGSAPGPAGQVQLQESGPGLVRPSQTLSLTC<br>TVSGYSITSDHAWSWVRQPPGRGLEWIGYISYSGITTYNPSLKSRVTMLRDTSKNQF<br>SLRLSSVTAADTAVYYCARSLARTTAMDYWGQGSLVTVSSGGTSTEPSEGSAPGSE<br>PATSGSETPGSPAGSPTSTEEGSTSSTAESPGPGTSTPESGSASPGSTSESPSGTAPGST<br>SESPSGTAPGTSTPESGSASPGTSTPESGSASPGSEPATSGSETPGTSESATPESGPGSP<br>AGSPTSTEEGTSTEPSEGSAPGTSESATPESGPGTSTEPSEGSAPGTSTEPSEGSAPGSP<br>AGSPTSTEEGTSTEPSEGSAPGTSTEPSEGSAPGTSESATPESGPGTSESATPESGPGTS<br>TEPSEGSAPGTSTEPSEGSAPGTSESATPESGPGTSTEPSEGSAPGSEPATSGSETPGSP<br>AGSPTSTEEGSSTPSGATGSPGTPGSGTASSSPGSSTPSGATGSPGTSTEPSEGSAPGT<br>STEPSEGSAPGSEPATSGSETPGSPAGSPTSTEEGSPAGSPTSTEEGTSTEPSEGSAPGA<br>SASGAPSTGGTSESATPESGPGSPAGSPTSTEEGSPAGSPTSTEEGSTSSTAESPGPGST<br>SESPSGTAPGTSPSGESSTAPGTPGSGTASSSPGSSTPSGATGSPGSSPSASTGTGPGSE<br>PATSGSETPGTSESATPESGPGSEPATSGSETPGTSSTAESPGPGSTSSTAESPGPGTS<br>PSGESSTAPGSEPATSGSETPGSEPATSGSETPGTSTEPSEGSAPGSTSSTAESPGPGTS<br>TPESGSASPGSTSESPSGTAPGTSTEPSEGSAPGTSTEPSEGSAPGTSTEPSEGSAPGSS<br>TPSGATGSPGSSPSASTGTGPGASPGTSSTGSPGSEPATSGSETPGTSESATPESGPGSP<br>AGSPTSTEEGSSTPSGATGSPGSSPSASTGTGPGASPGTSSTGSPGTSESATPESGPGT<br>STEPSEGSAPGTSTEPSEGSAPG | 815 |
| AM923-<br>aIL6R_VH-<br>AE42-<br>aCD40_VL | MAEPAGSPTSTEEGASPGTSSTGSPGSSTPSGATGSPGSSTPSGATGSPGTSTEPSEGS<br>APGSEPATSGSETPGSPAGSPTSTEEGSTSSTAESPGPGTSTPESGSASPGSTSESPSGT<br>APGSTSESPSGTAPGTSTPESGSASPGTSTPESGSASPGSEPATSGSETPGTSESATPES<br>GPGSPAGSPTSTEEGSTSTEPSEGSAPGTSESATPESGPGTSTEPSEGSAPGTSTEPSEGS<br>APGSPAGSPTSTEEGSTSTEPSEGSAPGTSTEPSEGSAPGTSESATPESGPGTSESATPES<br>GPGTSTEPSEGSAPGTSTEPSEGSAPGTSESATPESGPGTSTEPSEGSAPGSEPATSGSE<br>TPGSPAGSPTSTEEGSSTPSGATGSPGTPGSGTASSSPGSSTPSGATGSPGTSTEPSEGS<br>APGTSTEPSEGSAPGSEPATSGSETPGSPAGSPTSTEEGSPAGSPTSTEEGTSTEPSEGS<br>APGASASGAPSTGGTSESATPESGPGSPAGSPTSTEEGSPAGSPTSTEEGSTSSTAESP<br>GPGSTSESPSGTAPGTSPSGESSTAPGTPGSGTASSSPGSSTPSGATGSPGSSPSASTGT<br>GPGSEPATSGSETPGTSESATPESGPGSEPATSGSETPGTSSTAESPGPGSTSSTAESP<br>GPGTSPSGESSTAPGSEPATSGSETPGSEPATSGSETPGTSTEPSEGSAPGSTSSTAESP<br>GPGTSTPESGSASPGSTSESPSGTAPGTSTEPSEGSAPGTSTEPSEGSAPGTSTEPSEGS<br>APGSSTPSGATGSPGSSPSASTGTGPGASPGTSSTGSPGSEPATSGSETPGTSESATPES<br>GPGSPAGSPTSTEEGSSTPSGATGSPGSSPSASTGTGPGASPGTSSTGSPGTSESATPES<br>GPGTSTEPSEGSAPGTSTEPSEGSAPGQVQLQESGPGLVRPSQTLSLTCTVSGYSITSD | 816 |

TABLE 40-continued

Binding fusion proteins with targeting moieties to single targets

| Name* | Protein Sequence | SEQ ID NO: |
|---|---|---|
| | HAWSWVRQPPGRGLEWIGYISYSGITTYNPSLKSRVTMLRDTSKNQFSLRLSSVTAA DTAVYYCARSLARTTAMDYWGQGSLVTVSSGGAPGTSESATPESGPGSEPATSGSE TPGTSTEPSEGSAPGPAGMAEIVLTQSPATLSLSPGERATLSCRASQSISDYLHWYQQ KPGQAPRLLIYYASHSISGIPARFSGSGSGTDFTLTISSLEPEDFAVYYCQHGHSYPW TFGGGTKVEIKG | |
| aIL6R_VL-Y32-aIL6R_VH-AM1296 | DIQMTQSPSSLSASVGDRVTITCRASQDISSYLNWYQQKPGKAPKLLIYYTSRLHSG VPSRFSGSGSGTDFTFTISSLQPEDIATYYCQQGNTLPYTFGQGTKVEIKGTGSGEGS EGEGGGEGSEGEGSGEGGEGEGSGSGQVQLQESGPGLVRPSQTLSLTCTVSGYSITS DHAWSWVRQPPGRGLEWIGYISYSGITTYNPSLKSRVTMLRDTSKNQFSLRLSSVTA ADTAVYYCARSLARTTAMDYWGQGSLVTVSSGGTSTEPSEGSAPGSEPATSGSETP GSPAGSPTSTEEGSTSSTAESPGPGTSTPESGSASPGSTSESPSGTAPGSTSESPSGTAP GTSTPESGSASPGTSTPESGSASPGSEPATSGSETPGTSESATPESGPGSPAGSPTSTEE GTSTEPSEGSAPGTSESATPESGPGTSTEPSEGSAPGTSTEPSEGSAPGSPAGSPTSTEE GTSTEPSEGSAPGTSTEPSEGSAPGTSESATPESGPGTSESATPESGPGTSTEPSEGSAP GTSTEPSEGSAPGTSESATPESGPGTSTEPSEGSAPGSEPATSGSETPGSPAGSPTSTEE GSSTPSGATGSPGTPGSGTASSSPGSSTPSGATGSPGTSTEPSEGSAPGTSTEPSEGSAP GSEPATSGSETPGSPAGSPTSTEEGSPAGSPTSTEEGTSTEPSEGSAPGPEPTGPAPSG GSEPATSGSETPGTSESATPESGPGSPAGSPTSTEEGTSESATPESGPGSPAGSPTSTEE GSPAGSPTSTEEGTSESATPESGPGSPAGSPTSTEEGSPAGSPTSTEEGSTSSTAESPGP GSTSESPSGTAPGSPSGESSTAPGSTSESPSGTAPGSTSESPSGTAPGTSPSGESSTAP GTSTEPSEGSAPGTSESATPESGPGTSESATPESGPGSEPATSGSETPGTSESATPESGP GTSESATPESGPGTSTEPSEGSAPGTSESATPESGPGTSTEPSEGSAPGTSPSGESSTAP GTSPSGESSTAPGTSPSGESSTAPGTSTEPSEGSAPGSPAGSPTSTEEGTSTEPSEGSAP GSSPSASTGTGPGSSTPSGATGSPGSSTPSGATGSPGSSTPSGATGSPGSSTPSGATGS PGASPGTSSTGSPGASASGAPSTGGTSPSGESSTAPGSTSSTAESPGPGTSPSGESSTA PGTSESATPESGPGTSTEPSEGSAPGTSTEPSEGSAPGSSPSASTGTGPGSSTPSGATGS PGASPGTSSTGSPGTSTPESGSASPGTSPSGESSTAPGTSPSGESSTAPGTSESATPESG PGSEPATSGSETPGTSTEPSEGSAPGTSESPSGTAPGTSESPSGTAPGTSTPESGSAS PGSPAGSPTSTEEGTSESATPESGPGTSTEPSEGSAPGSPAGSPTSTEEGTSESATPESG PGSEPATSGSETPGSSTPSGATGSPGASPGTSSTGSPGSSTPSGATGSPGTSESPSGTA PGTSPSGESSTAPGSTSSTAESPGPGSSTPSGATGSPGASPGTSSTGSPGTPGSGTASSS PGSPAGSPTSTEEGSPAGSPTSTEEGTSTEPSEGSAPG | 817 |
| aCD40-AE864 | MAEIVLTQSPATLSLSPGERATLSCRASQSISDYLHWYQQKPGQAPRLLIYYASHSIS GIPARFSGSGSGTDFTLTISSLEPEDFAVYYCQHGHSYPWTFGGGTKVEIKGTGSGEG EGEGGGEGSEGEGSGEGGEGEGSGTQVQLVQSGSELKKPGASVKVSCKASGYAFTT TGMQWVRQAPGQGLEWMGWINTHSGVPKYVEDFKGRFVFSLDTSVSTAYLQISSL KAEDTAVYYCARSGNGNYDLAYFKYWGQGTLVTVSSGGSPAGSPTSTEEGTSESA TPESGPGTSTEPSEGSAPGSPAGSPTSTEEGTSTEPSEGSAPGTSTEPSEGSAPGTSESA TPESGPGSEPATSGSETPGSEPATSGSETPGSPAGSPTSTEEGSESATPESGPGTSTEP SEGSAPGTSTEPSEGSAPGSPAGSPTSTEEGTSTEPSEGSAPGTSTEPSEGSAPGTSESA TPESGPGTSTEPSEGSAPGTSESATPESGPGSEPATSGSETPGTSTEPSEGSAPGTSTEP SEGSAPGTSESATPESGPGTSESATPESGPGSPAGSPTSTEEGTSESATPESGPGSEPAT SGSETPGTSESATPESGPGTSTEPSEGSAPGTSTEPSEGSAPGTSESATPESGPGTSTEP SEGSAPGTSESATPESGPGSAPGSPAGSPTSTEEGTSTEPSEGSAPGTSESAPGTSESA TPESGPGSEPATSGSETPGTSESATPESGPGSEPATSGSETPGTSESATPESGPGTSTEP SEGSAPGTSESATPESGPGSPAGSPTSTEEGSPAGSPTSTEEGSPAGSPTSTEEGTSESA TPESGPGTSTEPSEGSAPGTSESATPESGPGSEPATSGSETPGTSESATPESGPGSEPAT SGSETPGTSESATPESGPGTSTEPSEGSAPGSPAGSPTSTEEGTSESATPESGPGSEPAT SGSETPGTSESATPESGPGSPAGSPTSTEEGTSTEPSEGSAPGTSTEPSEGSAPGTSESA TPESGPGTSESATPESGPGTSESATPESGPGSEPATSGSETPGSEPATSGSETPGSPAGS PTSTEEGTSTEPSEGSAPGTSTEPSEGSAPGSEPATSGSETPGTSESATPESGPGTSTEP SEGSAP | 818 |
| AE912-aCD40 | MAEPAGSPTSTEEGTPGSGTASSSPGSSTPSGATGSPGASPGTSSTGSPGSPAGSPTST EEGTSESATPESGPGTSTEPSEGSAPGSPAGSPTSTEEGTSTEPSEGSAPGTSTEPSEGS APGTSESATPESGPGSEPATSGSETPGSEPATSGSETPGSPAGSPTSTEEGTSESATPES GPGTSTEPSEGSAPGTSTEPSEGSAPGSPAGSPTSTEEGTSTEPSEGSAPGTSTEPSEGS APGTSESATPESGPGTSTEPSEGSAPGTSESATPESGPGSEPATSGSETPGTSTEPSEGS APGTSTEPSEGSAPGTSESATPESGPGSPAGSPTSTEEGTSESATPES GPGSEPATSGSETPGTSESATPESGPGTSTEPSEGSAPGTSTEPSEGSAPGTSTEPSEGS APGTSTEPSEGSAPGTSTEPSEGSAPGTSTEPSEGSAPGSPAGSPTSTEEGTSTEPSEGS APGTSESATPESGPGSEPATSGSETPGTSESATPESGPGSEPATSGSETPGTSESATPES GPGTSTEPSEGSAPGTSESATPESGPGSPAGSPTSTEEGSPAGSPTSTEEGSPAGSPTST EEGTSESATPESGPGTSTEPSEGSAPGTSESATPESGPGSEPATSGSETPGTSESATPES GPGSEPATSGSETPGTSESATPESGPGTSTEPSEGSAPGSPAGSPTSTEEGTSESATPES GPGSEPATSGSETPGTSESATPESGPGSPAGSPTSTEEGTSTEPSEGSAPGTSTEPSEGS APGTSESATPESGPGTSESATPESGPGTSESATPESGPGSEPATSGSETPGSEPATSGSE TPGSPAGSPTSTEEGTSTEPSEGSAPGTSTEPSEGSAPGSEPATSGSETPGTSESATPES GPGTSTEPSEGSAPGEIVLTQSPATLSLSPGERATLSCRASQSISDYLHWYQQKPGQA PRLLIYYASHSISGIPARFSGSGSGTDFTLTISSLEPEDFAVYYCQHGHSYPWTFGGGT | 819 |

TABLE 40-continued

Binding fusion proteins with targeting moieties to single targets

| Name* | Protein Sequence | SEQ ID NO: |
|---|---|---|
| | KVEIKTGSGEGSEGEGGGEGSEGEGSGEGGEGEGSGTQVQLVQSGSELKKPGASVK<br>VSCKASGYAFTTTGMQWVRQAPGQGLEWMGWINTHSGVPKYVEDFKGRFVFSLD<br>TSVSTAYLQISSLKAEDTAVYYCARSGNGNYDLAYFKYWGQGTLVTVS | |
| AE912-<br>aCD40_VH-<br>AF144-<br>aCD40_VL | MAEPAGSPTSEEGTPGSGTASSSPGSSTPSGATGSPGASPGTSSTGSPGSPAGSPTST<br>EEGTSESATPESGPGTSTEPSEGSAPGSPAGSPTSTEEGTSTEPSEGSAPGTSTEPSEGS<br>APGTSESATPESGPGSEPATSGSETPGSEPATSGSETPGSPAGSPTSTEEGTSESATPES<br>GPGTSTEPSEGSAPGTSTEPSEGSAPGSPAGSPTSTEEGTSTEPSEGSAPGTSTEPSEGS<br>APGTSESATPESGPGTSTEPSEGSAPGTSESATPESGPGSEPATSGSETPGTSTEPSEGS<br>APGTSTEPSEGSAPGTSESATPESGPGTSESATPESGPGSPAGSPTSTEEGTSESATPES<br>GPGSEPATSGSETPGTSESATPESGPGTSTEPSEGSAPGTSTEPSEGSAPGTSTEPSEGS<br>APGTSTEPSEGSAPGTSTEPSEGSAPGTSTEPSEGSAPGSPAGSPTSTEEGTSTEPSEGS<br>APGTSESATPESGPGSEPATSGSETPGTSESATPESGPGSEPATSGSETPGTSESATPES<br>GPGTSTEPSEGSAPGTSESATPESGPGSPAGSPTSTEEGSPAGSPTSTEEGSPAGSPTST<br>EEGTSESATPESGPGTSTEPSEGSAPGTSESATPESGPGSEPATSGSETPGTSESATPES<br>GPGSEPATSGSETPGTSESATPESGPGTSTEPSEGSAPGSPAGSPTSTEEGTSESATPES<br>GPGSEPATSGSETPGTSESATPESGPGSPAGSPTSTEEGSPAGSPTSTEEGTSTEPSEGS<br>APGTSESATPESGPGTSESATPESGPGSEPATSGSETPGSEPATSGSE<br>TPGSPAGSPTSTEEGTSTEPSEGSAPGSPAGSPTSTEEGTSESATPES<br>GPGTSTEPSEGSAPGQVQLVQSGSELKKPGASVKVSCKASGYAFTTTGMQWVRQA<br>PGQGLEWMGWINTHSGVPKYVEDFKGRFVFSLDTSVSTAYLQISSLKAEDTAVYYC<br>ARSGNGNYDLAYFKYWGQGTLVTVSSGGTSTPESGSASPGTSPSGESSTAPGTSPSG<br>ESSTAPGSTSSTAESPGPGSTSESPSGTAPGSTSSTAESPGPGSSTAPGTSTPE<br>SGSASPGSTSSTAESPGPGTSPSGESSTAPGTSPSGESSTAPGTSPSGESSTAPGMAEIV<br>LTQSPATLSLSPGERATLSCRASQSISDYLHWYQQKPGQAPRLLIYYASHSISGIPARF<br>SGSGSGTDFTLTISSLEPEDFAVYYCQHGHSYPWTFGGGTKVEIKG | 820 |
| aCD40_VL-<br>AE144-<br>aCD40_VH-<br>AE576 | MAEIVLTQSPATLSLSPGERATLSCRASQSISDYLHWYQQKPGQAPRLLIYYASHSIS<br>GIPARFSGSGSGTDFTLTISSLEPEDFAVYYCQHGHSYPWTFGGGTKVEIKGGSEPAT<br>SGSETPGTSESATPESGPGSEPATSGSETPGSPAGSPTSTEEGTSTEPSEGSAPGSEPAT<br>SGSETPGSEPATSGSETPGSEPATSGSETPGTSTEPSEGSAPGTSESATPESGPGSEPAT<br>SGSETPGTSTEPSEGSAPGQVQLVQSGSELKKPGASVKVSCKASGYAFTTTGMQWV<br>RQAPGQGLEWMGWINTHSGVPKYVEDFKGRFVFSLDTSVSTAYLQISSLKAEDTAV<br>YYCARSGNGNYDLAYFKYWGQGTLVTVSSGGSPAGSPTSTEEGTSESATPESGPGT<br>STEPSEGSAPGSPAGSPTSTEEGTSTEPSEGSAPGTSTEPSEGSAPGTSESATPESGPGS<br>EPATSGSETPGSEPATSGSETPGSPAGSPTSTEEGTSESATPESGPGTSTEPSEGSAPGT<br>STEPSEGSAPGSPAGSPTSTEEGTSTEPSEGSAPGTSTEPSEGSAPGTSESATPESGPGT<br>STEPSEGSAPGTSESATPESGPGSEPATSGSETPGTSTEPSEGSAPGTSTEPSEGSAPGT<br>SESATPESGPGTSESATPESGPGSPAGSPTSTEEGTSESATPESGPGSEPATSGSETPGT<br>SESATPESGPGTSTEPSEGSAPGTSESATPESGPGSEPATSGSETPGSEPATSGSAPGT<br>STEPSEGSAPGTSTEPSEGSAPGSPAGSPTSTEEGTSTEPSEGSAPGTSESATPESGPGS<br>EPATSGSETPGTSESATPESGPGSEPATSGSETPGTSESATPESGPGTSTEPSEGSAPGT<br>SESATPESGPGSPAGSPTSTEEGSPAGSPTSTEEGSPAGSPTSTEEGTSESATPESGPGT<br>STEPSEGSAPG | 821 |
| aCD40_VL-<br>AE42-<br>aCD40_VH-<br>BC864 | MAEIVLTQSPATLSLSPGERATLSCRASQSISDYLHWYQQKPGQAPRLLIYYASHSIS<br>GIPARFSGSGSGTDFTLTISSLEPEDFAVYYCQHGHSYPWTFGGGTKVEIKGGAPGTS<br>ESATPESGPGSEPATSGSETPGTSTEPSEGSAPGPAGQVQLVQSGSELKKPGAGVKVS<br>CKASGYAFTTTGMQWVRQAPGQGLEWMGWINTHSGVPKYVEDFKGRFVFSLDTS<br>VSTAYLQISSLKAEDTAVYYCARSGNGNYDLAYFKYWGQGTLVTVSSGGTSTEPSE<br>PGSAGTSTEPSEPGSAGSEPATSGTEPSGSGASEPTSTEPGSEPATSGTEPSGSEPATS<br>GTEPSGSEPATSGTEPSGSGASEPTSTEPGTSTEPSEPGSAGSEPATSGTEPSGTSTEPS<br>EPGSAGSEPATSGTEPSGSEPATSGTEPSGTSTEPSEPGSAGTSTEPSEPGSAGSEPATS<br>GTEPSGSEPATSGTEPSGTSEPSTSEPGAGSGASEPTSTEPGTSEPSTSEPGAGSEPATS<br>GTEPSGSEPATSGTEPSGSEPATSGTEPSGSAGTSTEPSEPGSAGSGASEPTSTEPGSEPATS<br>GTEPSGSEPATSGTEPSGSEPATSGTEPSGSEPATSGTEPSGTSTEPSEPGSAGSEPATS<br>GTEPSGSGASEPTSTEPGTSTEPSEPGSAGTSTEPSEPGSAGTSTEPGTSTEPS<br>EPGSAGSGASEPTSTEPGSEPATSGTEPSGSGASEPTSTEPGSEPATSGTEPSGSGASE<br>PTSTEPGTSTEPSEPGSAGSEPATSGTEPSGSGASEPTSTEPGTSTEPSEPGSAGSEPAT<br>SGTEPSGTSTEPSEPGSAGSEPATSGTEPSGTSTEPSEPGSAGTSTEPSEPGSAGTSTEP<br>SEPGSAGTSTEPSEPGSAGTSTEPSEPGSAGTSTEPSEPGSAGTSTEPSEPGAGSGAS<br>EPTSTEPGTSTEPSEPGSAGTSTEPSEPGSAGTSTEPSEPGSAGSEPATSGTEPSGSGAS<br>EPTSTEPGSEPATSGTEPSGSEPATSGTEPSGSEPATSGTEPSGSEPATSGTEPSGTSEP<br>STSEPGAGSEPATSGTEPSGSGASEPTSTEPGTSTEPSEPGSAGSEPATSGTEPSGSGA<br>SEPTSTEPGTSTEPSEPGSAG | 822 |
| AM923-<br>aCD40_VH-<br>AE42-BD864 | MAEPAGSPTSEEGASPGTSSTGSPGSSTPSGATGSPGSSTPSGATGSPGTSTEPSEGS<br>APGSEPATSGSETPGSPAGSPTSTEEGSTSSTAESPGPGTSTPESGSASPGSTSESPSGT<br>APGSTSESPSGTAPGSTSTPESGSASPGTSTPESGSASPGSEPATSGSETPGTSESATPES<br>GPGSPAGSPTSTEEGTSTEPSEGSAPGTSESATPESGPGTSTEPSEGSAPGTSTEPSEGS<br>APGSPAGSPTSTEEGTSTEPSEGSAPGTSTEPSEGSAPGTSESATPESGPGTSESATPES<br>GPGTSTEPSEGSAPGTSTEPSEGSAPGTSESATPESGPGTSTEPSEGSAPGSEPATSGSE<br>TPGSPAGSPTSTEEGSSTPSGATGSPGTPGSGTASSSPGSSTPSGATGSPGTSTEPSEGS<br>APGTSTEPSEGSAPGSEPATSGSETPGSPAGSPTSTEEGSPAGSPTSTEEGTSTEPSEGS | 823 |

TABLE 40-continued

Binding fusion proteins with targeting moieties to single targets

| Name* | Protein Sequence | SEQ ID NO: |
|---|---|---|
| | APGASASGAPSTGGTSESATPESGPGSPAGSPTSTEEGSPAGSPTSTEEGSTSSTAESP GPGSTSESPSGTAPGTSPSGESSTAPGTPGSGTASSSPGSSTPSGATGSPGSSPSASTGT GPGSEPATSGSETPGTSESATPESGPGSEPATSGSETPGSTSSTAESPGPGSTSSTAESP GPGTSPSGESSTAPGSEPATSGSETPGSEPATSGSETPGTSTEPSEGSAPGSTSSTAESP GPGTSTPESGSASPGSTSESPSGTAPGTSTEPSEGSAPGTSTEPSEGSAPGTSTEPSEGS APGSSTPSGATGSPGSSPSASTGTGPGASPGTSSTGSPGSEPATSGSETPGTSESATPES GPGSPAGSPTSTEEGSSTPSGATGSPGSSPSASTGTGPGASPGTSSTGSPGTSESATPES GPGTSTEPSEGSAPGTSTEPSEGSAPGQVQLVQSGSELKKPGASVKVSCKASGYAFT TTGMQWVRQAPGQGLEWMGWINTHSGVPKYVEDFKGRFVFSLDTSVSTAYLQISS LKAEDTAVYYCARSGNGNYDLAYFKYWGQGTLVTVSSGGAPGTSESATPESGPGS EPATSGSETPGTSTEPSEGSAPGPAGGSETATSGSETAGTSESATSESGAGSTAGSETS TEAGTSESATSESGAGSETATSGSETAGSETATSGSETAGTSTEASEGSASGTSTEAS EGSASGTSESATSESGAGSETATSGSETAGTSTEASEGSASGSTAGSETSTEAGTSES ATSESGAGTSESATSESGAGSETATSGSETAGTSESATSESGAGTSTEASEGSASGSE TATSGSETAGSETATSGSETAGTSTEASEGSASGSTAGSETSTEAGTSESATSESGAG TSTEASEGSASGSETATSGSETAGSTAGSETSTEAGSTAGSETSTEAGSETATSGSET AGTSESATSESGAGTSESATSESGAGSETATSGSETAGTSESATSESGAGTSESATSES GAGSETATSGSETAGSETATSGSETAGTSTEASEGSASGSTAGSETSTEAGSETATSG SETAGTSESATSESGAGSTAGSETSTEAGSTAGSETSTEAGSETATSGSETAGTSTEA SEGSASGSTAGSETSTEAGSTAGSETSTEAGTSTEASEGSASGSTAGSETSTEAGSET ATSGSETAGTSTEASEGSASGTSESATSESGAGSETATSGSETAGTSESATSESGAGT SESATSESGAGSETATSGSETAGTSESATSESGAGSETATSGSETAGTSTEASEGSAS GTSTEASEGSASGSTAGSETSTEAGSTAGSETSTEAGSETATSGSETAGTSESATSES GAGTSESATSESGAGSETATSGSETAGSETATSGSETAGSETATSGSETAGTSTEASE GSASGTSESATSESGAGSETATSGSETAGSETATSGSETAGTSESATSESGAGTSESA TSESGAGSETATSGSETAG | |
| aCD40_VL-Y32-aCD40_VH-AE576 | MAEIVLTQSPATLSLSPGERATLSCRASQSISDYLHWYQQKPGQAPRLLIYYASHSIS GIPARFSGSGSGTDFTLTISSLEPEDFAVYYCQHGHSYPWTFGGGTKVEIKGTSGSGEG SEGEGGGEGSEGEGSGEGGEGEGSGSGQVQLVQSGSELKKPGASVKVSCKASGYAF TTTGMQWVRQAPGQGLEWMGWINTHSGVPKYVEDFKGRFVFSLDTSVSTAYLQIS SLKAEDTAVYYCARSGNGNYDLAYFKYWGQGTLVTVSSGGSPAGSPTSTEEGTSES ATPESGPGTSTEPSEGSAPGSPAGSPTSTEEGTSTEPSEGSAPGTSTEPSEGSAPGTSES ATPESGPGSEPATSGSETPGSEPATSGSETPGSPAGSPTSTEEGTSESATPESGPGTSTE PSEGSAPGTSTEPSEGSAPGSPAGSPTSTEEGTSTEPSEGSAPGTSTEPSEGSAPGTSES ATPESGPGTSTEPSEGSAPGTSESATPESGPGSEPATSGSETPGTSTEPSEGSAPGTSTE PSEGSAPGTSESATPESGPGTSESATPESGPGSPAGSPTSTEEGTSESATPESGPGSEPA TSGSETPGTSESATPESGPGTSTEPSEGSAPGTSTEPSEGSAPGTSTEPSEGSAPGTSTE PSEGSAPGTSTEPSEGSAPGTSTEPSEGSAPGSPAGSPTSTEEGTSTEPSEGSAPGTSES ATPESGPGSEPATSGSETPGTSESATPESGPGSEPATSGSETPGTSESATPESGPGTSTE PSEGSAPGTSESATPESGPGSPAGSPTSTEEGSPAGSPTSTEEGSPAGSPTSTEEGTSES ATPESGPGTSTEPSEGSAPG | 824 |
| AE912-aCD40_VH-AF144-aCD40_VL | MAEPAGSPTSTEEGTPGSGTASSSPGSSTPSGATGSPGASPGTSSTGSPGSPAGSPTST EEGTSESATPESGPGTSTEPSEGSAPGSPAGSPTSTEEGTSTEPSEGSAPGTSTEPSEGS APGTSESATPESGPGSEPATSGSETPGSEPATSGSETPGSPAGSPTSTEEGTSESATPES GPGTSTEPSEGSAPGTSTEPSEGSAPGSPAGSPTSTEEGTSTEPSEGSAPGTSTEPSEGS APGTSESATPESGPGTSTEPSEGSAPGTSESATPESGPGSEPATSGSETPGTSTEPSEGS APGTSTEPSEGSAPGTSESATPESGPGTSESATPESGPGSPAGSPTSTEEGTSESATPES GPGSEPATSGSETPGTSESATPESGPGTSTEPSEGSAPGTSTEPSEGSAPGTSTEPSEGS APGTSTEPSEGSAPGTSTEPSEGSAPGTSTEPSEGSAPGSPAGSPTSTEEGTSTEPSEGS APGTSESATPESGPGSEPATSGSETPGTSESATPES GPGTSTEPSEGSAPGTSESATPESGPGSPAGSPTSTEEGSPAGSPTSTEEGSPAGSPTST EEGTSESATPESGPGTSTEPSEGSAPGTSESATPESGPGSEPATSGSETPGTSESATPES GPGSEPATSGSETPGTSESATPESGPGTSTEPSEGSAPGSPAGSPTSTEEGTSESATPES GPGSEPATSGSETPGTSESATPESGPGSPAGSPTSTEEGSPAGSPTSTEEGTSTEPSEGS APGTSESATPESGPGTSESATPESGPGSEPATSGSETPGSEPATSGSE TPGSPAGSPTSTEEGTSTEPSEGSAPGTSTEPSEGSAPGSEPATSGSETPGTSESATPES GPGTSTEPSEGSAPGQVQLVQSGSELKKPGASVKVSCKASGYAFTTTGMQWVRQA PGQGLEWMGWINTHSGVPKYVEDFKGRFVFSLDTSVSTAYLQISSLKAEDTAVYYC ARSGNGNYDLAYFKYWGQGTLVTVSSGGTSTPESGSASPGTSPSGESSTAPGTSPSG ESSTAPGSTSSTAESPGPGSTSESPSGTAPGSTSSTAESPGPGTSPSGESSTAPGTSTPE SGSASPGSTSSTAESPGPGTSPSGESSTAPGTSPSGESSTAPGSPSGESSTAPGMAEIV LTQSPATLSLSPGERATLSCRASQSISDYLHWYQQKPGQAPRLLIYYASHSISGIPARF SGSGSGTDFTLTISSLEPEDFAVYYCQHGHSYPWTFGGGTKVEIKG | 825 |
| aCD40_VL-AE144-aCD40_VH-AE576 | MAEIVLTQSPATLSLSPGERATLSCRASQSISDYLHWYQQKPGQAPRLLIYYASHSIS GIPARFSGSGSGTDFTLTISSLEPEDFAVYYCQHGHSYPWTFGGGTKVEIKGGSEPAT SGSETPGTSESATPESGPGSEPATSGSETPGSPAGSPTSTEEGTSTEPSEGSAPGSEPAT SGSETPGSEPATSGSETPGSEPATSGSETPGTSTEPSEGSAPGTSESATPESGPGSEPAT SGSETPGTSTEPSEGSAPGQVQLVQSGSELKKPGASVKVSCKASGYAFTTTGMQWV RQAPGQGLEWMGWINTHSGVPKYVEDFKGRFVFSLDTSVSTAYLQISSLKAEDTAV YYCARSGNGNYDLAYFKYWGQGTLVTVSSGGSPAGSPTSTEEGTSESATPESGPGT STEPSEGSAPGSPAGSPTSTEEGTSTEPSEGSAPGTSTEPSEGSAPGTSESATPESGPGS | 826 |

TABLE 40-continued

Binding fusion proteins with targeting moieties to single targets

| Name* | Protein Sequence | SEQ ID NO: |
|---|---|---|
| | EPATSGSETPGSEPATSGSETPGSPAGSPTSTEEGTSESATPESGPGTSTEPSEGSAPGT<br>STEPSEGSAPGSPAGSPTSTEEGTSTEPSEGSAPGTSTEPSEGSAPGTSESATPESGPGT<br>STEPSEGSAPGTSESATPESGPGSEPATSGSETPGTSTEPSEGSAPGTSTEPSEGSAPGT<br>SESATPESGPGTSESATPESGPGSPAGSPTSTEEGTSESATPESGPGSEPATSGSETPGT<br>SESATPESGPGTSTEPSEGSAPGTSTEPSEGSAPGTSTEPSEGSAPGTSTEPSEGSAPGT<br>STEPSEGSAPGTSTEPSEGSAPGSPAGSPTSTEEGTSTEPSEGSAPGTSESATPESGPGS<br>EPATSGSETPGTSESATPESGPGSEPATSGSETPGTSESATPESGPGTSTEPSEGSAPGT<br>SESATPESGPGSPAGSPTSTEEGSPAGSPTSTEEGSPAGSPTSTEEGTSESATPESGPGT<br>STEPSEGSAPG | |
| aHER2-<br>AE864 | MEDIQMTQSPSSLSASVGDRVTITCRASQDVNTAVAWYQQKPGKAPKLLIYSASFL<br>YSGVPSRFSGSRSGTDFTLTISSLQPEDFATYYCQQHYTTPPTFGQGTKVEIKTGSGE<br>GSEGEGGGEGSEGEGSGEGGEGEGSGTEVQLVESGGGLVQPGGSLRLSCAASGFNI<br>KDTYIHWVRQAPGKGLEWVARIYPTNGYTRYADSVKGRFTISADTSKNTAYLQMN<br>SLRAEDTAVYYCSRWGGDGFYAMDYWGQGTLVTVSGSPGSPAGSPTSTEEGTSES<br>ATPESGPGTSTEPSEGSAPGSPAGSPTSTEEGTSTEPSEGSAPGTSTEPSEGSAPGTSES<br>ATPESGPGSEPATSGSETPGSEPATSGSETPGSPAGSPTSTEEGTSESATPESGPGTSTE<br>PSEGSAPGTSTEPSEGSAPGSPAGSPTSTEEGTSTEPSEGSAPGTSTEPSEGSAPGTSES<br>ATPESGPGTSTEPSEGSAPGTSESATPESGPGSEPATSGSETPGTSTEPSEGSAPGTSTE<br>PSEGSAPGTSESATPESGPGTSESATPESGPGSPAGSPTSTEEGTSESATPESGPGSEPA<br>TSGSETPGTSESATPESGPGTSTEPSEGSAPGTSTEPSEGSAPGTSTEPSEGSAPGTSTE<br>PSEGSAPGTSTEPSEGSAPGTSTEPSEGSAPGSPAGSPTSTEEGTSTEPSEGSAPGTSES<br>ATPESGPGSEPATSGSETPGTSESATPESGPGSEPATSGSETPGTSESATPESGPGTSTE<br>PSEGSAPGTSESATPESGPGSPAGSPTSTEEGSPAGSPTSTEEGSPAGSPTSTEEGTSESE<br>ATPESGPGTSTEPSEGSAPGTSESATPESGPGSEPATSGSETPGTSESATPESGPGSEPA<br>TSGSETPGTSESATPESGPGTSTEPSEGSAPGSPAGSPTSTEEGTSESATPESGPGSEPA<br>TSGSETPGTSESATPESGPGSPAGSPTSTEEGSPAGSPTSTEEGTSTEPSEGSAPGTSES<br>ATPESGPGTSESATPESGPGTSESATPESGPGSEPATSGSETPGSEPATSGSETPGSPA<br>GSPTSTEEGTSTEPSEGSAPGTSTEPSEGSAPGSEPATSGSETPGTSESATPESGPGTST<br>EPSEGSAP | 827 |
| AE912-<br>aHER2 | MAEPAGSPTSTEEGTPGSGTASSSPGSSTPSGATGSPGASPGTSSTGSPGSPAGSPTST<br>EEGTSESATPESGPGTSTEPSEGSAPGSPAGSPTSTEEGTSTEPSEGSAPGTSTEPSEGS<br>APGTSESATPESGPGSEPATSGSETPGSEPATSGSETPGSPAGSPTSTEEGTSESATPES<br>GPGTSTEPSEGSAPGTSTEPSEGSAPGSPAGSPTSTEEGTSTEPSEGSAPGTSTEPSEGS<br>APGTSESATPESGPGTSTEPSEGSAPGTSESATPESGPGSEPATSGSETPGTSTEPSEGS<br>APGTSTEPSEGSAPGTSESATPESGPGTSESATPESGPGSPAGSPTSTEEGTSESATPES<br>GPGSEPATSGSETPGTSESATPESGPGTSTEPSEGSAPGTSTEPSEGSAPGTSTEPSEGS<br>APGTSTEPSEGSAPGTSTEPSEGSAPGTSTEPSEGSAPGSPAGSPTSTEEGTSTEPSEGS<br>APGTSESATPESGPGSEPATSGSETPGTSESATPESGPGSEPATSGSETPGTSESATPES<br>GPGTSTEPSEGSAPGTSESATPESGPGSPAGSPTSTEEGSPAGSPTSTEEGSPAGSPTST<br>EEGTSESATPESGPGTSTEPSEGSAPGTSESATPESGPGSEPATSGSETPGTSESATPES<br>GPGSEPATSGSETPGTSESATPESGPGTSTEPSEGSAPGSPAGSPTSTEEGTSESATPES<br>GPGSEPATSGSETPGTSESATPESGPGSPAGSPTSTEEGSPAGSPTSTEEGTSTEPSEGS<br>APGTSESATPESGPGTSESATPESGPGTSESATPESGPGSEPATSGSETPGSEPATSGSE<br>TPGSPAGSPTSTEEGTSTEPSEGSAPGTSTEPSEGSAPGSEPATSGSETPGTSESATPES<br>GPGTSTEPSEGSAPGSSSLDIQMTQSPSSLSASVGDRVTITCRASQDVNTAVAWYQQ<br>KPGKAPKLLIYSASFLYSGVPSRFSGSRSGTDFTLTISSLQPEDFATYYCQQHYTTPPT<br>FGQGTKVEIKTGSGEGSEGEGGGEGSEGEGSGEGGEGEGSGTEVQLVESGGGLVQP<br>GGSLRLSCAASGFNIKDTYIHWVRQAPGKGLEWVARIYPTNGYTRYADSVKGRFTI<br>SADTSKNTAYLQMNSLRAEDTAVYYCSRWGGDGFYAMDYWGQGTLVTVS | 828 |
| aHer2_VL-<br>AE42-<br>aHer2_VH-<br>AM1296 | MEDIQMTQSPSSLSASVGDRVTITCRASQDVNTAVAWYQQKPGKAPKLLIYSASFL<br>YSGVPSRFSGSRSGTDFTLTISSLQPEDFATYYCQQHYTTPPTFGQGTKVEIKGGAPG<br>TSESATPESGPGSEPATSGSETPGTSTEPSEGSAPGPAGEVQLVESGGGLVQPGGSLR<br>LSCAASGFNIKDTYIHWVRQAPGKGLEWVARIYPTNGYTRYADSVKGRFTISADTS<br>KNTAYLQMNSLRAEDTAVYYCSRWGGDGFYAMDYWGQGTLVTVSGGTSTEPSEG<br>SAPGSEPATSGSETPGSPAGSPTSTEEGSTSSTAESPGPGTSTPSEGSASPGSTSESPSG<br>TAPGSTSESPSGTAPGTSTPESGSASPGTSTPESGSASPGSEPATSGSETPGTSESATPE<br>SGPGSPAGSPTSTEEGTSTEPSEGSAPGTSESATPESGPGTSTEPSEGSAPGTSTEPSEG<br>SAPGSPAGSPTSTEEGTSTEPSEGSAPGTSESATPESGPGTSESATPESGPGTSESATPE<br>SGPGTSTEPSEGSAPGTSTEPSEGSAPGTSESATPESGPGTSTEPSEGSAPGSEPATSGS<br>ETPGSPAGSPTSTEEGSSTPSGATGSPGTPGSGTASSSPGSSTPSGATGSPGTSTEPSEG<br>SAPGTSTEPSEGSAPGSEPATSGSETPGSPAGSPTSTEEGSPAGSPTSTEEGTSTEPSEG<br>SAPGPEPTGPAPSGGSEPATSGSETPGTSESATPESGPGSPAGSPTSTEEGTSESATPES<br>GPGSPAGSPTSTEEGSPAGSPTSTEEGTSESATPESGPGSPAGSPTSTEEGSPAGSPTST<br>EEGSTSSTAESPGPGSTSESPSGTAPGTSPSGESSTAPGSTSESPSGTAPGSTSESPSGT<br>APGTSPSGESSTAPGTSTEPSEGSAPGTSESATPESGPGTSESATPESGPGSEPATSGSE<br>TPGTSESATPESGPGTSESATPESGPGTSTEPSEGSAPGTSTEPSEGSAPGTSTEPSEGS<br>APGTSPSGESSTAPGTSPSGESSTAPGTSPSGESSTAPGTSTEPSEGSAPGSPAGSPTST<br>EEGTSTEPSEGSAPGSSPSASTGTGPGSSTPSGATGSPGSSTPSGATGSPGSSTPSGAT<br>GSPGSSTPSGATGSPGASPGTSSTGSPGASASGAPSTGGTSPSGESSTAPGSTSSTAES<br>PGPGTSPSGESSTAPGTSESATPESGPGTSTEPSEGSAPGTSTEPSEGSAPGSSPSASTG<br>TGPGSSTPSGATGSPGASPGTSSTGSPGTSTPESGSASPGTSPSGESSTAPGTSPSGESS | 829 |

TABLE 40-continued

Binding fusion proteins with targeting moieties to single targets

| Name* | Protein Sequence | SEQ ID NO: |
|---|---|---|
| | TAPGTSESATPESGPGSEPATSGSETPGTSTEPSEGSAPGSTSESPSGTAPGSTSESPSG TAPGTSTPESGSASPGSPAGSPTSTEEGTSESATPESGPGTSTEPSEGSAPGSPAGSPTS TEEGTSESATPESGPGSEPATSGSETPGSSTPSGATGSPGASPGTSSTGSPGSSTPSGAT GSPGSTSESPSGTAPGTSPSGESSTAPGSTSSTAESPGPGSSTPSGATGSPGASPGTSST GSPGTPGSGTASSSPGSPAGSPTSTEEGSPAGSPTSTEEGTSTEPSEGSAPG | |
| AE912-aHER2_VL-AF144-aHER2_VH | MAEPAGSPTSTEEGTPGSGTASSSPGSSTPSGATGSPGASPGTSSTGSPGSPAGSPTST EEGTSESATPESGPGTSTEPSEGSAPGSPAGSPTSTEEGTSTEPSEGSAPGTSTEPSEGS APGTSESATPESGPGSEPATSGSETPGSEPATSGSETPGSPAGSPTSTEEGTSESATPES GPGTSTEPSEGSAPGTSTEPSEGSAPGSPAGSPTSTEEGTSTEPSEGSAPGTSTEPSEGS APGTSESATPESGPGTSTEPSEGSAPGTSESATPESGPGSEPATSGSETPGTSESATPES APGTSTEPSEGSAPGTSESATPESGPGTSESATPESGPGSPAGSPTSTEEGTSESATPES GPGSEPATSGSETPGTSESATPESGPGTSTEPSEGSAPGTSTEPSEGSAPGTSTEPSEGS APGTSTEPSEGSAPGTSTEPSEGSAPGTSTEPSEGSAPGSPAGSPTSTEEGTSTEPSEGS APGTSESATPESGPGSEPATSGSETPGTSESATPES GPGTSTEPSEGSAPGTSESATPESGPGSPAGSPTSTEEGSPAGSPTSTEEGSPAGSPTST EEGTSESATPESGPGTSTEPSEGSAPGTSESATPESGPGSEPATSGSETPGTSESATPES GPGSEPATSGSETPGTSESATPESGPGTSTEPSEGSAPGSPAGSPTSTEEGTSESATPES GPGSEPATSGSETPGTSESATPESGPGSPAGSPTSTEEGSPAGSPTSTEEGTSTEPSEGS APGTSESATPESGPGTSESATPESGPGTSESATPESGPGSEPATSGSETPGSEPATSGSE TPGSPAGSPTSTEEGTSTEPSEGSAPGTSTEPSEGSAPGSEPATSGSETPGTSESATPES GPGTSTEPSEGSAPGMEDIQMTQSPSSLSASVGDRVTITCRASQDVNTAVAWYQQK PGKAPKLLIYSASFLYSGVPSRFSGSRSGTDFTLTISSLQPEDFATYYCQQHYTTPPTF GQGTKVEIKGGTSTPESGSASPGTSPSGESSTAPGTSPSGESSTAPGSTSSTAESPGPG STSESPSGTAPGSTSSTAESPGPGTSPSGESSTAPGSTPESGSASPGSTSSTAESPGPG TSPSGESSTAPGTSPSGESSTAPGTSPSGESSTAPGEVQLVESGGGLVQPGGSLRLSC AASGFNIKDTYIHWVRQAPGKGLEWVARIYPTNGYTRYADSVKGRFTISADTSKNT AYLQMNSLRAEDTAVYYCSRWGGDGFYAMDYWGQGTLVTVSG | 830 |
| AE48-aHER2_VH-AE144-aHER2_VL-AE576 | MAEPAGSPTSTEEGTPGSGTASSSPGSSTPSGATGSPGASPGTSSTGSPGEVQLVESG GGLVQPGGSLRLSCAASGFNIKDTYIHWVRQAPGKGLEWVARIYPTNGYTRYADS VKGRFTISADTSKNTAYLQMNSLRAEDTAVYYCSRWGGDGFYAMDYWGQGTLVT VSGGSEPATSGSETPGTSESATPESGPGSEPATSGSETPGSPAGSPTSTEEGTSTEPSEG SAPGSEPATSGSETPGSEPATSGSETPGSEPATSGSETPGTSTEPSEGSAPGTSESATPE SGPGSEPATSGSETPGTSTEPSEGSAPGMEDIQMTQSPSSLSASVGDRVTITCRASQD VNTAVAWYQQKPGKAPKLLIYSASFLYSGVPSRFSGSRSGTDFTLTISSLQPEDFAT YYCQQHYTTPPTFGQGTKVEIKGGSPAGSPTSTEEGTSESATPESGPGTSTEPSEGSA PGSPAGSPTSTEEGTSTEPSEGSAPGTSTEPSEGSAPGTSESATPESGPGSEPATSGSET PGSEPATSGSETPGSPAGSPTSTEEGTSESATPESGPGTSTEPSEGSAPGTSTEPSEGSA PGSPAGSPTSTEEGTSTEPSEGSAPGTSTEPSEGSAPGTSTEPSEGSAPGTSTEPSEGSA PGTSESATPESGPGSEPATSGSETPGTSTEPSEGSAPGTSTEPSEGSAPGTSESATPESG PGTSESATPESGPGSPAGSPTSTEEGTSESATPESGPGSEPATSGSETPGTSESATPESG PGTSTEPSEGSAPGTSTEPSEGSAPGTSTEPSEGSAPGTSTEPSEGSAPGTSTEPSEGSA PGTSTEPSEGSAPGSPAGSPTSTEEGTSTEPSEGSAPGTSESATPESGPGSEPATSGSET PGTSESATPESGPGSEPATSGSETPGTSESATPESGPGTSTEPSEGSAPGTSESATPESG PGSPAGSPTSTEEGSPAGSPTSTEEGSPAGSPTSTEEGTSESATPESGPGTSTEPSEGSA PG | 831 |
| aHer2_VH_1-AE288-aHer2_VL_1-AF576 | EVQLVESGGGLVQPGGSLRLSCAASGFNIKDTYIHWVRQAPGKGLEWVARIYPTNG YTRYADSVKGRFTISADTSKNTAYLQMNSLRAEDTAVYYCSRWGGDGFYAMDYW GQGTLVTVSGGTSESATPESGPGSEPATSGSETPGTSESATPESGPGSEPATSGSETPG TSESATPESGPGTSTEPSEGSAPGSPAGSPTSTEEGTSESATPESGPGSEPATSGSETPG TSESATPESGPGSPAGSPTSTEEGSPAGSPTSTEEGTSTEPSEGSAPGTSESATPESGPG TSESATPESGPGTSESATPESGPGSEPATSGSETPGSEPATSGSETPGSPAGSPTSTEEG TSTEPSEGSAPGTSTEPSEGSAPGSEPATSGSETPGTSESATPESGPGTSTEPSEGSAPG MEDIQMTQSPSSLSASVGDRVTITCRASQDVNTAVAWYQQKPGKAPKLLIYSASFL YSGVPSRFSGSRSGTDFTLTISSLQPEDFATYYCQQHYTTPPTFGQGTKVEIKGGSTS STAESPGPGSTSSTAESPGPGSTSESPSGTAPGSTSSTAESPGPGSTSSTAESPGPGTSST PESGSASPGSTSESPSGTAPGTSPSGESSTAPGSTSESPSGTAPGSTSESPSGTAPGTSP SGESSTAPGSTSESPSGTAPGSTSESPSGTAPGTSPSGESSTAPGSTSESPSGTAPGSTS ESPSGTAPGSTSESPSGTAPGSTPESGSASPGSTSSTAESPGPGTSSTAESPGPGSTS STAESPGPGSTSSTAESPGPGTSTPESGSASPGTSTPESGSASPGSTSESPSGTAPGTST PESGSASPGTSTPESGSASPGSTSESPSGTAPGSTSESPSGTAPGSTSESPSGTAPGSTS STAESPGPGTSTPESGSASPGTSTPESGSASPGSTSESPSGTAPGSTSESPSGTAPGTST PESGSASPGSTSESPSGTAPGSTSESPSGTAPGTSTPESGSASPGTSPSGESSTAPGSTS STAESPGPGTSPSGESSTAPGSTSSTAESPGPGTSPSGESSTAPGSTSESPSGTAPGSTS STAESPGPGTSTPESGSASPGTSTPESGSASPG | 832 |
| aEGFR-Y576 | MEDILLTQSPVILSVSPGERVSFSCRASQSIGTNIHWYQQRTNGSPRLLIKYASESISGI PSRFSGSGSGTDFTLSINSVESEDIADYYCQQNNNWPTTFGAGTKLELKTGSGEGSE GEGGGEGSEGEGSGEGGEGEGSGTQVQLKQSGPGLVQPSQSLSITCTVSGFSLTNYG VHWVRQSPGKGLEWLGVIWSGGNTDYNTPFTSRLSINKDNSKSQVFFKMNSLQSN DTAIYYCARALTYYDEFAYWGQGTLVTVSGGEGSEGSEGEGSEGSEGEGEGSEGS GEGEGGSEGSEGEGSEGSGEGEGGEGSGEGEGSGEGSEGEGGGEGSEGEGSGEGGE | 833 |

TABLE 40-continued

Binding fusion proteins with targeting moieties to single targets

| Name* | Protein Sequence | SEQ ID NO: |
|---|---|---|
| | GEGSEGGSEGEGGSEGGEGEGSEGSGEGEGSEGGSEGEGSEGGSEGEGSEGSGEGE<br>GSEGSGEGEGSEGGSGEGEGSEGSGEGEGSEGGSEGEGGSEGGSEGGSEGEGSEGEGGS<br>EGSEGEGGGEGSEGEGSGEGSEGEGGSEGSEGEGGSEGSEGEGGEGSGEGEGSEGS<br>GEGEGSGEGSEGEGSEGSGEGEGSEGSGEGEGGSEGSEGEGSGEGSEGEGSEGSGEG<br>EGSEGSGEGEGGSEGSEGEGGSEGSEGEGGSEGSEGEGGEGSGEGEGSEGSGEGEGS<br>GEGSEGEGSEGSGEGEGSEGSGEGEGGSEGSEGEGSEGSGEGEGGEGSGEGEGSGE<br>GSEGEGGGEGSEGEGSEGSGEGEGSEGSGEGEGGSEGSEGEGSEGSGEGEGSEGGSE<br>GEGSEGGSEGEGSEGSGEGEGSEGSGEGEGSGEGSEGEGGSEGGEGEGSEGGSEGE<br>GSEGGSEGEGGEGSGEGEGGGEGSEGEGSEGSGEGEGSGEGSEG | |
| aEGFR_VL-<br>AE42-<br>aEGFR_VH-<br>AD836 | MEDILLTQSPVILSVSPGERVSFSCRASQSIGTNIHWYQQRTNGSPRLLIKYASESISGI<br>PSRFSGSGSGTDFTLSINSVESEDIADYYCQQNNNWPTTFGAGTKLELKGGAPGTSE<br>SATPESGPGSEPATSGSETPGTSTEPSEGSAPGPAGQVQLKQSGPGLVQPSQSLSITCT<br>VSGFSLTNYGVHWVRQSPGKGLEWLGVIWSGGNTDYNTPFTSRLSINKDNSKSQVF<br>FKMNSLQSNDTAIYYCARALTYYDYEFAYWGQPTLVTVSGGSSESEGGPGSSE<br>SGSSEGGPGESPGGSSGSESGSGGEPSESGSSGESPGGSSGSESGESPGGSSGSESGSS<br>ESGSSEGGPGSSESGSSEGGPGSSESGSSEGGPGESPGGSSGSESGESPGGSSGSESGE<br>SPGGSSGSESGSSESGSSEGGPGSSESGSSEGGPGSSESGSSEGGPGSSESGSSEGGPG<br>SSESGSSEGGPGSSGGEPSESGSSGESPGGSSGSESGESPGGSSGSES<br>GSGGEPSESGSSGSEGSSGPGESSGGSESGSSEGGPGSGGEPSESGSSGSEGSSGPGES<br>SGSSSESGSSEGGPGSGGEPSESGSSGESPGGSSGSESGSGGEPSESGSSGSGGEPSESG<br>SSGSSESGSSEGGPGSGGEPSESGSSGSGGEPSESGSSGSEGSSGPGESSGESPGGSSG<br>SEGGSEGSSGPGESSGEGSSGPGESSGGSGGEPSESGSSGSEGSSEGGPGSSESGSSE<br>GGPGESPGGSSGSESGSGGEPSESGSSGSEGSSGPGESSGESPGGSSGSESGSEGSSGP<br>GSSESGSSEGGPGSGGEPSESGSSGSEGSSGPGESSGSEGSSGPGESSGSEGSSGPGES<br>SGSGGEPSESGSSGSGGEPSESGSSGESPGGSSGSESGESPGGSSGSESGSGGEPSESG<br>SSGSESSSGPGESSGESPGGSSGSESSSEGGPGSSESGSSEGGPGSSESGSSEG<br>GPGSGGEPSGSSGSESGSSEGGPGESPGGSSGSESGSGGEPSESGSSGSESSSE<br>GGPGESPGGSSGSESGSGGEPSESGSSGESPGGSSGSESGSGGEPSESGSSG | 834 |
| AM923-<br>aEGFR_VL-<br>AM150-<br>aEGFR_VH_1 | MAEPAGSPTSTEEGASPGTSSTGSPGSSTPSGATGSPGSSTPGATGSPGTSTEPSEGS<br>APGSEPATSGSETPGSPAGSPTSTEEGSTSSTAESPGPGTSTPESGSASPGSTSESPSGT<br>APGSTSESPSGTAPGSTSTPESGSASPGTSTPESGSASPGSEPATSGSETPGTSESATPES<br>GPGSPAGSPTSTEEGTSTEPSEGSAPGTSESATPESGPGTSTEPSEGSAPGTSTEPSEGS<br>APGSPAGSPTSTEEGTSTEPSEGSAPGTSTEPSEGSAPGTSESATPESGPGTSESATPES<br>GPGTSTEPSEGSAPGTSTEPSEGSAPGTSESATPESGPGTSTEPSEGSAPGSEPATSGSE<br>TPGSPAGSPTSTEEGSSTPSGATGSPGTPGSGTASSSPGSSTPSGATGSPGTSTEPSEGS<br>APGTSTEPSEGSAPGSEPATSGSETPGSPAGSPTSTEEGSPAGSPTSTEEGTSTEPSEGS<br>APGASASGAPSTGGTSESATPESGPGSPAGSPTSTEEGSPAGSPTSTEEGSTSSTAESP<br>GPGSTSESPSGTAPGTSPSGESSTAPGTPGSGTASSSPGSSTPSGATGSPGSSPSASTGT<br>GPGSEPATSGSETPGTSESATPESGPGSEPATSGSETPGTSSTAESPGPGTSTSSTAESP<br>GPGTSPSGESSTAPGSEPATSGSETPGSEPATSGSETPGTSTEPSEGSAPGTSSTAESP<br>GPGTSTPESGSASPGSTSESPSGTAPGTSTEPSEGSAPGTSTEPSEGSAPGTSTEPSEGS<br>APGSSTPSGATGSPGSSPSASTGTGPGASPGTSSTGSPGSEPATSGSETPGTSESATPES<br>GPGSPAGSPTSTEEGSSTPSGATGSPGSSPSASTGTGPGASPGTSSTGSPGTSESATPES<br>GPGTSTEPSEGSAPGTSTEPSEGSAPGMEDILLTQSPVILSVSPGERVSFSCRASQSIGT<br>NIHWYQQRTNGSPRLLIKYASESISGIPSRFSGSGSGTDFTLSINSVESEDIADYYCQQ<br>NNNWPTTFGAGTKLELKGGAPSTGGTSESATPESGPGTSTEPSEGSAPGTSTEPSEGS<br>APGTSESATPESGPGTSTEPSEGSAPGTSTEPSEGSAPGTSESATPESGPGTSTEPSEGS<br>APGTSTEPSEGSAPGTSTEPSEGSAPGSPAGSPTSTEEGTSTEPSEGSAPGPEPTGPAG<br>QVQLKQSGPGLVQPSQSLSITCTVSGFSLTNYGVHWVRQSPGKGLEWLGVIWSGGN<br>TDYNTPFTSRLSINKDNSKSQVFFKMNSLQSNDTAIYYCARALTYYDYEFAYWGQG<br>TLVTVSG | 835 |
| aEGFR_VH-<br>AF144-<br>aEGFR_VL-<br>AF864 | QVQLKQSGPGLVQPSQSLSITCTVSGFSLTNYGVHWVRQSPGKGLEWLGVIWSGGN<br>TDYNTPFTSRLSINKDNSKSQVFFKMNSLQSNDTAIYYCARALTYYDYEFAYWGQG<br>TLVTVSGGTSTPESGSASPGTSPSGESSTAPGTSPSGESSTAPGTSSTAESPGPGTSTSE<br>SPSGTAPGTSSTAESPGPGTSPSGESSTAPGTSTPESGSASPGSTSSTAESPGPGTSPS<br>GESSTAPGTSPSGESSTAPGMEDILLTQSPVILSVSPGERVSFSCRAS<br>QSIGTNIHWYQQRTNGSPRLLIKYASESISGIPSRFSGSGSGTDFTLSINSVESEDIADY<br>YCQQNNNWPTTFGAGTKLELKGGSTSESPSGTAPGTSPSGESSTAPGTSESPSGTAP<br>GTSTSESPSGTAPGTSPESGSASPGTSTPESGSASPGSTSESPSGTAPGSTSESPSGTAP<br>GTSPSGESSTAPGSTSESPSGTAPGTSPSGESSTAPGTSPSGESSTAPGSTSSTAESPGP<br>GTSPSGESSTAPGTSPSGESSTAPGSTSSTAESPGPGTSTPESGSASPGTSTPESGSASP<br>GSTSESPSGTAPGSTSESPSGTAPGTSTPESGSASPGSTSSTAESPGPGTSTPESGSASP<br>GSTSESPSGTAPGTSPSGESSTAPGSTSSTAESPGPGTSPSGESSTAPGTSTPESGSASP<br>GSTSSTAESPGPGSTSSTAESPGPGSTSSTAESPGPGSTSSTAESPGPGTSPSGESSTAP<br>GSTSESPSGTAPGSTSESPSGTAPGTSTPESGPXXXGASASGAPSTXXXXSESPSGTAP<br>GSTSESPSGTAPGSTSESPSGTAPGSTSESPSGTAPGSTSESPSGTAPGSTSESPSGTAP<br>GTSTPESGSASPGTSPSGESSTAPGTSPSGESSTAPGSTSSTAESPGPGTSPSGESSTAP<br>GTSTPESGSASPGTSPSGESSTAPGTSPSGESSTAPGTSPSGESSTAPGSTSESPSGTAP<br>GTSTPESGSASPGTSTPESGSASPGSTSESPSGTAPGTSTPESGSASPGSTSSTAESPGP<br>GSTSESPSGTAPGSTSESPSGTAPGTSPSGESSTAPGSTSSTAESPGPGTSPSGESSTAP<br>GTSTPESGSASPGTSPSGESSTAPGTSPSGESSTAPGTSPSGESSTAPGSTSSTAESPGP | 836 |

TABLE 40-continued

Binding fusion proteins with targeting moieties to single targets

| Name* | Protein Sequence | SEQ ID NO: |
|---|---|---|
| | GSTSSTAESPGPGTSPSGESSTAPGSSPSASTGTGPGSSTPSGATGSPGSSTPSGATGSPG | |
| AE912-aEGFR_VH-Y32-aEGFR_VL | MAEPAGSPTSTEEGTPGSGTASSSPGSSTPSGATGSPGASPGTSSTGSPGSPAGSPTST EEGTSESATPESGPGTSTEPSEGSAPGSPAGSPTSTEEGTSTEPSEGSAPGTSTEPSEGS APGTSESATPESGPGSEPATSGSETPGSEPATSGSETPGSPAGSPTSTEEGTSESATPES GPGTSTEPSEGSAPGTSTEPSEGSAPGSPAGSPTSTEEGTSTEPSEGSAPGTSTEPSEGS APGTSESATPESGPGTSTEPSEGSAPGTSESATPESGPGSEPATSGSETPGTSTEPSEGS APGTSTEPSEGSAPGTSESATPESGPGTSESATPESGPGSPAGSPTSTEEGTSESATPES GPGSEPATSGSETPGTSESATPESGPGTSTEPSEGSAPGTSTEPSEGSAPGTSTEPSEGS APGTSESATPESGPGTSTEPSEGSAPGTSTEPSEGSAPGSPAGSPTSTEEGTSESATPES APGTSESATPESGPGSEPATSGSETPGTSESATPESGPGSEPATSGSETPGTSESATPES GPGTSTEPSEGSAPGTSESATPESGPGSPAGSPTSTEEGSPAGSPTSTEEGSPAGSPTST EEGTSESATPESGPGTSTEPSEGSAPGTSESATPESGPGSEPATSGSETPGTSESATPES GPGSEPATSGSETPGTSESATPESGPGTSTEPSEGSAPGSPAGSPTSTEEGTSESATPES GPGSEPATSGSETPGTSESATPESGPGSPAGSPTSTEEGSPAGSPTSTEEGTSTEPSEGS APGTSESATPESGPGTSESATPESGPGTSESATPESGPGSEPATSGSETPGSEPATSGSE TPGSPAGSPTSTEEGTSTEPSEGSAPGTSTEPSEGSAPGSEPATSGSETPGTSESATPES GPGTSTEPSEGSAPGQVQLKQSGPGLVQPSQSLSITCTVSGFSLTNYGVHWVRQSPG KGLEWLGVIWSGGNTDYNTPFTSRLSINKDNSKSQVFFKMNSLQSNDTAIYYCARA LTYYDYEFAYWGQGTLVTVSGTGSGEGSEGEGGGEGSEGEGSGEGGEGEGSGSGM EDILLTQSPVILSVSPGERVSFSCRASQSIGTNIHWYQQRTNGSPRLLIKYASESISGIP SRFSGSGSGTDFTLSINSVESEDIADYYCQQNNNWPTTFGAGTKLELKG | 837 |
| aEGFR_VL-Linker_Y32-aEGFR_VH-BC864 | MEDILLTQSPVILSVSPGERVSFSCRASQSIGTNIHWYQQRTNGSPRLLIKYASESISGI PSRFSGSGSGTDFTLSINSVESEDIADYYCQQNNNWPTTFGAGTKLELKGTGSGEGS EGEGGGEGSEGEGSGEGGEGEGSGSGQVQLKQSGPGLVQPSQSLSITCTVSGFSLTN YGVHWVRQSPGKGLEWLGVIWSGGNTDYNTPFTSRLSINKDNSKSQVFFKMNSLQ SNDTAIYYCARALTYYDYEFAYWGQGTLVTVSGGTSTEPSEPGSAGTSTEPSEPGSA GSEPATSGTEPSGSGASEPTSTEPGSEPATSGTEPSGSEPATSGTEPSGSEPATSGTEPS GSGASEPTSTEPGTSTEPSEPGSAGSEPATSGTEPSGTSTEPSEPGSAGSEPATSGTEPS GSEPATSGTEPSGTSTEPSEPGSAGTSTEPSEPGSAGSEPATSGTEPSGSEPATSGTEPS GTSEPSTSEPGAGSGASEPTSTEPGTSEPSTSEPGAGSEPATSGTEPSGSEPATSGTEPS GTSTEPSEPGSAGTSTEPSEPGSAGSGASEPTSTEPGSEPATSGTEPSGSEPATSGTEPS GSEPATSGTEPSGSEPATSGTEPSGTSTEPSEPGSAGSEPATSGTEPSGSGASEPTSTEP GTSTEPSEPGSAGSEPATSGTEPSGSGASEPTSTEPGTSTEPSEPGSAGSEPATSGTEPS GSEPATSGTEPSGSGASEPTSTEPGSEPATSGTEPSGSGASEPTSTEPGTSTEPSEPGSA GSEPATSGTEPSGSGASEPTSTEPGTSTEPSEPGSAGSEPATSGTEPSGTSTEPSEPGSA GSEPATSGTEPSGTSTEPSEPGSAGTSTEPSEPGSAGTSTEPSEPGSAGTSTEPSEPGSA GTSTEPSEPGSAGTSTEPSEPGSAGTSEPSTSEPGAGSGASEPTSTEPGTSTEPSEPGSA GTSTEPSEPGSAGTSTEPSEPGSAGSEPATSGTEPSGSGASEPTSTEPGSEPATSGTEPS GSEPATSGTEPSGSEPATSGTEPSGSEPATSGTEPSGTSEPSTSEPGAGSEPATSGTEPS GSGASEPTSTEPGTSTEPSEPGSAGSEPATSGTEPSGSGASEPTSTEPGTSTEPSEPGSA G | 838 |
| aEGFR_VH-AE288-aEGFR_VL-BD864 | QVQLKQSGPGLVQPSQSLSITCTVSGFSLTNYGVHWVRQSPGKGLEWLGVIWSGGN TDYNTPFTSRLSINKDNSKSQVFFKMNSLQSNDTAIYYCARALTYYDYEFAYWGQG TLVTVSGGTSESATPESGPGSEPATSGSETPGTSESATPESGPGSEPATSGSETPGTSE SATPESGPGTSTEPSEGSAPGSPAGSPTSTEEGTSESATPESGPGSEPATSGSETPGTSE SATPESGPGSPAGSPTSTEEGSPAGSPTSTEEGTSTEPSEGSAPGTSESATPESGPGTSE SATPESGPGTSESATPESGPGSEPATSGSETPGSEPATSGSETPGSPAGSPTSTEEGTST EPSEGSAPGTSTEPSEGSAPGSEPATSGSETPGTSESATPESGPGTSTEPSEGSAPGME DILLTQSPVILSVSPGERVSFSCRASQSIGTNIHWYQQRTNGSPRLLIKYASESISGIPS RFSGSGSGTDFTLSINSVESEDIADYYCQQNNNWPTTFGAGTKLELKGGSETATSGS ETAGTSESATSESGAGSTAGSETSTEAGTSESATSESGAGSETATSGSETAGSETATS GSETAGTSTEASEGSASGTSTEASEGSASGTSESATSESGAGSETATSGSETAGTSTE ASEGSASGSTAGSETSTEAGTSESATSESGAGTSESATSESGAGSETATSGSETAGTS ESATSESGAGTSTEASEGSASGSETATSGSETAGSETATSGSETAGTSTEASEGSASG STAGSETSTEAGTSESATSESGAGTSTEASEGSASGSETATSGSETAGSTAGSETSTE AGSTAGSETSTEAGSETATSGSETAGTSESATSESGAGTSESATSESGAGSETATSGS ETAGTSESATSESGAGTSESATSESGAGSETATSGSETAGSETATSGSETAGTSTEAS EGSASGSTAGSETSTEAGSETATSGSETAGTSESATSESGAGSTAGSETSTEAGSTAG SETSTEAGSTAGSETSTEAGTSTEASEGSASGSTAGSETSTEAGSTAGSETSTEAGTST EASEGSASGSTAGSETSTEAGSETATSGSETAGTSTEASEGSASGTSESATSESGAGS ETATSGSETAGTSESATSESGAGTSESATSESGAGSETATSGSETAGTSESATSESGA GSETATSGSETAGTSTEASEGSASGTSTEASEGSASGSTAGSETSTEAGSTAGSETST EAGSETATSGSETAGTSESATSESGAGTSESATSESGAGSETATSGSETAGSETATSG SETAGSETATSGSETAGTSTEASEGSASGTSESATSESGAGSETATSGSETAGSETAT SGSETAGTSESATSESGAGTSESATSESGAGSETATSGSETAG | 839 |
| aCD3-Y288 | MKDIQMTQSPSSLSASVGDRVTITCSASSSVSYMNWYQQTPGKAPKRWIYDTSKLA SGVPSRFSGSGSGTDYTFTISSLQPEDIATYYCQQWSSNPFTFGQGTKLQITRTGSGE GSEGEGGGEGSEGEGSGEGGEGEGSGTQVQLVQSGGGVVQPGRSLRLSCKASGYTF TRYTMHWVRQAPGKGLEWIGYINPSRGYTNYNQKFKDRFTISTDKSKSTAFLQMDS | 840 |

TABLE 40-continued

Binding fusion proteins with targeting moieties to single targets

| Name* | Protein Sequence | SEQ ID NO: |
|---|---|---|
| | LRPEDTAVYYSARYYDDHYCLDYWGQGTPVTVSSGGEGSGEGSEGEGSEGSGEGE GSEGSGEGEGGSEGSEGEGGSEGSGEGEGGSGEGSEGEGGSEGSGEGEGSG EGSEGEGSEGGSEGEGSGEGSEGEGSEGSGEGEGGSGEGSEGSGEGEGSGEGS EGSEGSGEGEGSGEGSEGEGSEGSGEGEGSEGSGEGEGGSGEGSEGSGEGE GGEGSGEGEGSGEGSEGEGGGEGSEGSGEGGEGEGSEGGSEGEGGSEGGEGEGS EGSGEGEGSEGGSEGEGSEGGSEGEGSEGSGEGEGSEGSGEGS | |
| aCD3_VL-AF144-aCD3_VH-AE576 | MKDIQMTQSPSSLSASVGDRVTITCSASSSVSYMNWYQQTPGKAPKRWIYDTSKLA SGVPSRFSGSGSGTDYTFTISSLQPEDIATYYCQQWSSNPFTFGQGTKLQITRGGTST PESGSASPGTSPSGESSTAPGTSPSGESSTAPGTSSTAESPGPGTSESPSGTAPGSTS STAESPGPGTSPSGESSTAPGTSTPESGSASPGSTSSTAESPGPGTSPSGESSTAPGTSP SGESSTAPGTSPSGESSTAPGQVQLVQSGGGVVQPGRSLRLSCKASGYTFTRYTMH WVRQAPGKGLEWIGYINPSRGYTNYNQKFKDRFTISTDKSKSTAFLQMDSLRPEDT AVYYSARYYDDHYCLDYWGQGTPVTVSSGGSPAGSPTSTEEGTSESATPESGPGTS TEPSEGSAPGSPAGSPTSTEEGTSTEPSEGSAPGTSTEPSEGSAPGTSESATPESGPGSE PATSGSETPGSEPATSGSETPGSPAGSPTSTEEGTSESATPESGPGTSTEPSEGSAPGTS TEPSEGSAPGSPAGSPTSTEEGTSTEPSEGSAPGTSTEPSEGSAPGTSESATPESGPGTS TEPSEGSAPGTSESATPESGPGSEPATSGSETPGTSTEPSEGSAPGTSTEPSEGSAPGTS ESATPESGPGTSESATPESGPGSPAGSPTSTEEGTSESATPESGPGSEPATSGSETPGTS ESATPESGPGTSTEPSEGSAPGTSTEPSEGSAPGTSESATPESGPGTSTEPSEGSAPGTS TEPSEGSAPGTSTEPSEGSAPGSPAGSPTSTEEGTSTEPSEGSAPGTSESATPESGPGSE PATSGSETPGTSESATPESGPGSEPATSGSETPGTSESATPESGPGTSTEPSEGSAPGTS ESATPESGPGSPAGSPTSTEEGSPAGSPTSTEEGSPAGSPTSTEEGTSESATPESGPGTS TEPSEGSAPG | 841 |
| AM923-aCD3_VH-AM150-aCD3_VL | MAEPAGSPTSTEEGASPGTSSTGSPGSSTPSGATGSPGSSTPSGATGSPGTSTEPSEGS APGSEPATSGSETPGSPAGSPTSTEEGSTSSTAESPGPGTSTPESGSASPGSTSESPSGT APGSTSESPSGTAPGTSTPESGSASPGTSTPESGSASPGSEPATSGSETPGTSESATPES GPGSPAGSPTSTEEGTSTEPSEGSAPGTSESATPESGPGTSTEPSEGSAPGTSTEPSEGS APGSPAGSPTSTEEGTSTEPSEGSAPGTSTEPSEGSAPGTSESATPESGPGTSESATPES GPGTSTEPSEGSAPGTSTEPSEGSAPGTSESATPESGPGTSTEPSEGSAPGSEPATSGSE TPGSPAGSPTSTEEGSSTPSGATGSPGTPGSGTASSSPGSSTPSGATGSPGTSTEPSEGS APGTSTEPSEGSAPGSEPATSGSETPGSPAGSPTSTEEGSPAGSPTSTEEGTSTEPSEGS APGASASGAPSTGGTSESATPESGPGSPAGSPTSTEEGSPAGSPTSTEEGSTSSTAESP GPGTSESPSGTAPGTSPSGESSTAPGTPGSGTASSSPGSSTPSGATGSPGSSPSASTGT GPGSEPATSGSETPGTSESATPESGPGSEPATSGSETPGTSSTAESPGPGSTSSTAESP GPGTSPSGESSTAPGSEPATSGSETPGSEPATSGSETPGTSTEPSEGSAPGSTSSTAESP GPGTSTPESGSASPGSTSESPSGTAPGTSTEPSEGSAPGTSTEPSEGSAPGTSTEPSEGS APGSSTPSGATGSPGSSPSASTGTGPGASPGTSSTGSPGSEPATSGSETPGTSESATPES GPGSPAGSPTSTEEGSSTPSGATGSPGSSPSASTGTGPGASPGTSSTGSPGTSESATPES GPGTSTEPSEGSAPGTSTEPSEGSAPGQVQLVQSGGGVVQPGRSLRLSCKASGYTFT RYTMHWVRQAPGKGLEWIGYINPSRGYTNYNQKFKDRFTISTDKSKSTAFLQMDSL RPEDTAVYYSARYYDDHYCLDYWGQGTPVTVSSGGAPSTGGTSESATPESGPGTST EPSEGSAPGTSTEPSEGSAPGTSESATPESGPGTSTEPSEGSAPGTSTEPSEGSAPGTSE SATPESGPGTSTEPSEGSAPGTSTEPSEGSAPGTSTEPSEGSAPGSPAGSPTSTEEGTST EPSEGSAPGPEPTGPAGMKDIQMTQSPSSLSASVGDRVTITCSASSSVSYMNWYQQT PGKAPKRWIYDTSKLASGVPSRFSGSGSGTDYTFTISSLQPEDIATYYCQQWSSNPFT FGQGTKLQITRG | 842 |
| aCD3_VL-Linker_AE42-aCD3_VH-AM875 | MKDIQMTQSPSSLSASVGDRVTITCSASSSVSYMNWYQQTPGKAPKRWIYDTSKLA SGVPSRFSGSGSGTDYTFTISSLQPEDIATYYCQQWSSNPFTFGQGTKLQITRGGAPG TSESATPESGPGSEPATSGSETPGTSTEPSEGSAPGPAGQVQLVQSGGGVVQPGRSLR LSCKASGYTFTRYTMHWVRQAPGKGLEWIGYINPSRGYTNYNQKFKDRFTISTDKS KSTAFLQMDSLRPEDTAVYYSARYYDDHYCLDYWGQGTPVTVSSGGTSTEPSEGS APGSEPATSGSETPGSPAGSPTSTEEGSTSSTAESPGPGTSTPESGSASPGSTSESPSGT APGSTSESPSGTAPGTSTPESGSASPGTSTPESGSASPGSEPATSGSETPGTSESATPES GPGSPAGSPTSTEEGTSTEPSEGSAPGTSESATPESGPGTSESATPESGPGTSTEPSEGS APGSPAGSPTSTEEGTSTEPSEGSAPGTSTEPSEGSAPGTSESATPESGPGTSESATPES GPGTSTEPSEGSAPGTSTEPSEGSAPGTSESATPESGPGTSTEPSEGSAPGSEPATSGSE TPGSPAGSPTSTEEGSSTPSGATGSPGTPGSGTASSSPGSSTPSGATGSPGTSTEPSEGS APGTSTEPSEGSAPGSEPATSGSETPGSPAGSPTSTEEGSPAGSPTSTEEGSTSTEPSEGS APGASASGAPSTGGTSESATPESGPGSPAGSPTSTEEGSPAGSPTSTEEGSTSSTAESP GPGTSESPSGTAPGTSPSGESSTAPGTPGSGTASSSPGSSTPSGATGSPGSSPSASTGT GPGSEPATSGSETPGTSESATPESGPGSEPATSGSETPGTSSTAESPGPGSTSSTAESP GPGTSPSGESSTAPGSEPATSGSETPGSEPATSGSETPGTSTEPSEGSAPGSTSSTAESP GPGTSTPESGSASPGSTSESPSGTAPGTSTEPSEGSAPGTSTEPSEGSAPGTSTEPSEGS APGSSTPSGATGSPGSSPSASTGTGPGASPGTSSTGSPGSEPATSGSETPGTSESATPES GPGSPAGSPTSTEEGSSTPSGATGSPGSSPSASTGTGPGASPGTSSTGSPGTSESATPES GPGTSTEPSEGSAPGTSTEPSEGSAPG | 843 |

TABLE 40-continued

Binding fusion proteins with targeting moieties to single targets

| Name* | Protein Sequence | SEQ ID NO: |
|---|---|---|
| AE912-aCD3_VL-AE144-aCD3_VH | MAEPAGSPTSTEEGTPGSGTASSSPGSSTPSGATGSPGASPGTSSTGSPGSPAGSPTST EEGTSESATPESGPGTSTEPSEGSAPGSPAGSPTSTEEGTSTEPSEGSAPGTSTEPSEGS APGTSESATPESGPGSEPATSGSETPGSEPATSGSETPGSPAGSPTSTEEGTSESATPES GPGTSTEPSEGSAPGTSTEPSEGSAPGSPAGSPTSTEEGTSTEPSEGSAPGTSTEPSEGS APGTSESATPESGPGTSTEPSEGSAPGTSESATPESGPGSEPATSGSETPGTSTEPSEGS APGTSTEPSEGSAPGTSESATPESGPGTSESATPESGPGSPAGSPTSTEEGTSESATPES GPGSEPATSGSETPGTSESATPESGPGTSTEPSEGSAPGTSTEPSEGSAPGTSTEPSEGS APGTSTEPSEGSAPGTSTEPSEGSAPGTSTEPSEGSAPGSPAGSPTSTEEGTSTEPSEGS APGTSESATPESGPGSEPATSGSETPGTSESATPESGPGSEPATSGSETPGTSESATPES GPGTSTEPSEGSAPGTSESATPESGPGSPAGSPTSTEEGSPAGSPTSTEEGSPAGSPTST EEGTSESATPESGPGTSTEPSEGSAPGTSESATPESGPGSEPATSGSETPGTSESATPES GPGSEPATSGSETPGTSESATPESGPGTSTEPSEGSAPGSPAGSPTSTEEGTSESATPES GPGSEPATSGSETPGTSESATPESGPGSPAGSPTSTEEGSPAGSPTSTEEGTSTEPSEGS APGTSESATPESGPGTSESATPESGPGTSTEPSEGSAPGSPAGSPGSEPATSGSE TPGSPAGSPTSTEEGTSTEPSEGSAPGTSTEPSEGSAPGSEPATSGSETPGTSESATPES GPGTSTEPSEGSAPGMKDIQMTQSPSSLSASVGDRVTITCSASSSVSYMNWYQQTPG KAPKRWIYDTSKLASGVPSRFSGSGSGTDYTFTISSLQPEDIATYYCQQWSSNPFTFG QGTKLQITRGGSEGTSESATPESGPGTSESATPESGPGSEPATSGSETPGSPAGSPTSEEG TSTEPSEGSAPGSEPATSGSETPGSEPATSGSETPGSEPATSGSETPGTSTEPSEGSAPG TSESATPESGPGSEPATSGSETPGTSTEPSEGSAPGQVQLVQSGGGVVQPGRSLRLSC KASGYTFTRYTMHWVRQAPGKGLEWIGYINPSRGYTNYNQKFKDRFTISTDKSKST AFLQMDSLRPEDTAVYYSARYYDDHYCLDYWGQGTPVTVSSG | 844 |
| AE48-aCD3_VH-Linker_Y32-aCD3_VL-AE864 | MAEPAGSPTSTEEGTPGSGTASSSPGSSTPSGATGSPGASPGTSSTGSPGQVQLVQSG GGVVQPGRSLRLSCKASGYTFTRYTMHWVRQAPGKGLEWIGYINPSRGYTNYNQK FKDRFTISTDKSKSTAFLQMDSLRPEDTAVYYSARYYDDHYCLDYWGQGTPVTVSS GTGSGEGSEGEGGGEGSEGEGSGEGGEGEGSGSGMKDIQMTQSPSSLSASVGDRVT ITCSASSSVSYMNWYQQTPGKAPKRWIYDTSKLASGVPSRFSGSGSGTDYTFTISSL QPEDIATYYCQQWSSNPFTFGQGTKLQITRGGSPAGSPTSTEEGTSESATPESGPGTS TEPSEGSAPGSPAGSPTSTEEGTSTEPSEGSAPGTSTEPSEGSAPGTSESATPESGPGSE PATSGSETPGSEPATSGSETPGSPAGSPTSTEEGTSESATPESGPGTSTEPSEGSAPGTS TEPSEGSAPGSPAGSPTSTEEGTSTEPSEGSAPGTSTEPSEGSAPGTSESATPESGPGTS TEPSEGSAPGTSESATPESGPGSEPATSGSETPGTSTEPSEGSAPGTSTEPSEGSAPGTS ESATPESGPGTSESATPESGPGSPAGSPTSTEEGTSESATPESGPGSEPATSGSETPGTS ESATPESGPGTSTEPSEGSAPGTSTEPSEGSAPGTSESATPESGPGSPAGSPTSTEEGTS TEPSEGSAPGTSTEPSEGSAPGSPAGSPTSTEEGTSTEPSEGSAPGTSESATPESGPGSE PATSGSETPGTSESATPESGPGSEPATSGSETPGTSESATPESGPGTSTEPSEGSAPGTS ESATPESGPGSPAGSPTSTEEGSPAGSPTSTEEGTSESATPESGPGTSESATPESGPGTS TEPSEGSAPGTSESATPESGPGSEPATSGSETPGTSESATPESGPGSEPATSGSETPGTS ESATPESGPGTSTEPSEGSAPGSPAGSPTSTEEGTSESATPESGPGSEPATSGSETPGTS ESATPESGPGSPAGSPTSTEEGSPAGSPTSTEEGTSTEPSEGSAPGTSESATPESGPGTS ESATPESGPGTSESATPESGPGSEPATSGSETPGSEPATSGSETPGSPAGSPTSTEEGTS TEPSEGSAPGTSTEPSEGSAPGSEPATSGSETPGTSESATPESGPGTSTEPSEGSAPG | 845 |
| AM48-aCD3_VL-Linker_AE42-aCD3_VH-AM875 | MAEPAGSPTSTEEGASPGTSSTGSPGSSTPSGATGSPGSSTPSGATGSPGMKDIQMTQ SPSSLSASVGDRVTITCSASSSVSYMNWYQQTPGKAPKRWIYDTSKLASGVPSRFSG SGSGTDYTFTISSLQPEDIATYYCQQWSSNPFTFGQGTKLQITRGGAPGTSESATPES GPGSEPATSGSETPGTSTEPSEGSAPGPAGQVQLVQSGGGVVQPGRSLRLSCKASGY TFTRYTMHWVRQAPGKGLEWIGYINPSRGYTNYNQKFKDRFTISTDKSKSTAFLQM DSLRPEDTAVYYSARYYDDHYCLDYWGQGTPVTVSSGGTSTEPSEGSAPGSEPATS GSETPGSPAGSPTSTEEGSTSSTAESPGPGTSTPESGSASPGSTSESPSGTAPGSTSESP SGTAPGTSTPESGSASPGTSTPESGSASPGSEPATSGSETPGTSESATPESGPGSPAGSP TSTEEGTSTEPSEGSAPGTSESATPESGPGTSTEPSEGSAPGTSTEPSEGSAPGSPAGSP TSTEEGTSTEPSEGSAPGTSTEPSEGSAPGTSESATPESGPGTSESATPESGPGTSTEPS EGSAPGTSTEPSEGSAPGTSESATPESGPGTSTEPSEGSAPGSEPATSGSETPGSPAGSP TSTEEGSSTPSGATGSPGTPGSGTASSSPGSSTPSGATGSPGSSTPSGATGSPGSSTEPS EGSAPGSEPATSGSETPGSPAGSPTSTEEGSPAGSPTSTEEGTSTEPSEGSAPGASASG APSTGGTSESATPESGPGSPAGSPTSTEEGSPAGSPTSTEEGSTSSTAESPGPGTSESP SGTAPGTSPSGESSTAPGTPGSGTASSSPGSSTPSGATGSPGSSPSASTGTGPGSEPAT SGSETPGTSESATPESGPGSEPATSGSETPGTSTSPSGSPSG ESSTAPGSEPATSGSETPGSEPATSGSETPGTSTEPSEGSAPGTSSTAESPGPGTSTPE SGSASPGTSESPSGTAPGTSTEPSEGSAPGTSTEPSEGSAPGTSTEPSEGSAPGSSTPS GATGSPGSSPSASTGTGPGASPGTSSTGSPGSEPATSGSETPGTSESATPESGPGSPAG SPTSTEEGSSTPSGATGSPGSSPSASTGTGPGASPGTSSTGSPGTSESATPESGPGTSTE PSEGSAPGTSTEPSEGSAPG | 846 |
| aEGRF_VHH-Linker_Y32-aEGRF_VHH 1-BC864 | EVQLQESGGGLVQAGDSLRLSCLVSGRSFNSYTMGWFRQAPGKEREFVAAILWSGP TTYYADSVKGRFTISRDNAKNTVYLQMNSLKPEDTAVYYCAAALGVLVLAPGNVY SYWGQGTQVTVSSAHHGTSGEGSEGEGGGEGSEGEGSGEGGEGEGSGSGEVQLQ ESGGGLVQAGDSLRLSCLVSGRSFNSYTMGWFRQAPGKEREFVAAILWSGPTTYYA DSVKGRFTISRDNAKNTVYLQMNSLKPEDTAVYYCAAALGVLVLAPGNVYSYWG QGTQVTVSSAHHGGTSTEPSEPGSAGTSTEPSEPGSAGSEPATSGTEPSGSGASEPTS TEPGSEPATSGTEPSGSEPATSGTEPSGSEPATSGTEPSGSGASEPTSTEPGTSTEPSEP | 847 |

TABLE 40-continued

Binding fusion proteins with targeting moieties to single targets

| Name* | Protein Sequence | SEQ ID NO: |
|---|---|---|
| | GSAGSEPATSGTEPSGTSTEPSEPGSAGSEPATSGTEPSGSEPATSGTEPSGTSTEPSEP GSAGTSTEPSEPGSAGSEPATSGTEPSGSEPATSGTEPSGTSEPSTSEPGAGSGASEPT STEPGTSEPSTSEPGAGSGEPATSGTEPSGSEPATSGTEPSGTSTEPSEPGSAGTSTEPSE PGSAGSGASEPTSTEPGSEPATSGTEPSGSEPATSGTEPSGSEPATSGTEPSGSEPATS GTEPSGTSTEPSEPGSAGSEPATSGTEPSGSGASEPTSTEPGTSTEPSEPGSAGSEPATS GTEPSGSGASEPTSTEPGTSTEPSEPGSAGSGASEPTSTEPGSEPATSGTEPSGSGASEP TSTEPGSEPATSGTEPSGSGASEPTSTEPGTSTEPSEPGSAGSEPATSGTEPSGSGASEP TSTEPGTSTEPSEPGSAGSEPATSGTEPSGTSTEPSEPGSAGSEPATSGTEPSGTSTEPS EPGSAGTSTEPSEPGSAGTSTEPSEPGSAGTSTEPSEPGSAGTSTEPSEPGSAGTSTEPS EPGSAGTSEPSTSEPGAGSGASEPTSTEPGTSTEPSEPGSAGTSTEPSEPGSAGTSTEPS EPGSAGSEPATSGTEPSGSGASEPTSTEPGSEPATSGTEPSGSEPATSGTEPSGSEPATS GTEPSGSEPATSGTEPSGTSEPSTSEPGAGSEPATSGTEPSGSGASEPTSTEPGTSTEPS EPGSAGSEPATSGTEPSGSGASEPTSTEPGTSTEPSEPGSAG | |
| aEGRF_VHH-AE144-aEGRF_VHH-BD864 | EVQLQESGGGLVQAGDSLRLSCLVSGRSFNSYTMGWFRQAPGKEREFVAAILWSGP TTYYADSVKGRFTISRDNAKNTVYLQMNSLKPEDTAVYYCAAALGVLVLAPGNVY SYWGQGTQVTVSSAHHGGSEPATSGSETPGTSESATPESGPGSEPATSGSETPGSPA GSPTSTEEGTSTEPSEGSAPGSEPATSGSETPGSEPATSGSETPGSEPATSGSETPGTST EPSEGSAPGTSESATPESGPGSEPATSGSETPGTSTEPSEGSAPGEVQLQESGGGLVQ AGDSLRLSCLVSGRSFNSYTMGWFRQAPGKEREFVAAILWSGPTTYYADSVKGRFT ISRDNAKNTVYLQMNSLKPEDTAVYYCAAALGVLVLAPGNVYSYWGQGTQVTVS SAHHGGSETATSGSETAGTSESATSESGAGSTAGSETSTEAGTSESATSESGAGSETA TSGSETAGSETATSGSETAGTSTEASEGSASGTSTEASEGSASGTSESATSESGAGSE TATSGSETAGTSTEASEGSASGSTAGSETSTEAGTSESATSESGAGTSESATSESGAG SETATSGSETAGTSESATSESGAGTSTEASEGSASGSETATSGSETAGSETATSGGSET AGTSTEASEGSASGSTAGSETSTEAGTSESATSESGAGTSTEASEGSASGSETATSGS ETAGSTAGSETSTEAGTSTAGSETSTEAGSETATSGSETAGTSESATSESGAGTSESAT SESGAGSETATSGSETAGTSESATSESGAGTSESATSESGAGSETATSGSETAGSETA TSGSETAGTSTEASEGSASGSTAGSETSTEAGSETATSGSETAGTSESATSESGAGST AGSETSTEAGSTAGSETSTEAGSTAGSETSTEAGTSTEASEGSASGSTAGSETSTEAG STAGSETSTEAGTSTEASEGSASGSTAGSETSTEAGSETATSGSETAGTSTEASEGSA SGTSESATSESGAGSETATSGSETAGTSESATSESGAGTSESATSESGAGSETATSGSE TAGTSESATSESGAGSETATSGSETAGTSTEASEGSASGTSTEASEGSASGSTAGSET STEAGSTAGSETSTEAGSETATSGSETAGTSESATSESGAGTSESATSESGAGSETAT SGSETAGSETATSGSETAGSETATSGSETAGTSTEASEGSASGTSESATSESGAGSET ATSGSETAGSETATSGSETAGTSESATSESGAGTSESATSESGAGSETATSGSETAG | 848 |
| aEGRF_VHH-AF144-aEGRF_VHH-AE576 | EVQLQESGGGLVQAGDSLRLSCLVSGRSFNSYTMGWFRQAPGKEREFVAAILWSGP TTYYADSVKGRFTISRDNAKNTVYLQMNSLKPEDTAVYYCAAALGVLVLAPGNVY SYWGQGTQVTVSSAHHGGSTSTPESGSASPGTSPSPSGESSTAPGTSPSGESSTAPGSTSS TAESPGPGSTSESPSGTAPGSTSSTAESPGPGTSPSGESSTAPGTSPSGESSTAPGSTSS TAESPGPGTSPSGESSTAPGTSPSGESSTAPGEVQLQESGGGLVQA GDSLRLSCLVSGRSFNSYTMGWFRQAPGKEREFVAAILWSGPTTYYADSVKGRFTI SRDNAKNTVYLQMNSLKPEDTAVYYCAAALGVLVLAPGNVYSYWGQGTQVTVSS AHHGGSPAGSPTSTEEGTSESATPESGPGTSTEPSEGSAPGSPAGSPTSTEEGTSTEPS EGSAPGTSTEPSEGSAPGTSESATPESGPGSEPATSGSETPGSEPATSGSETPGSPAGSP TSTEEGTSESATPESGPGTSTEPSEGSAPGTSTEPSEGSAPGSPAGSPTSTEEGTSTEPS EGSAPGTSTEPSEGSAPGTSESATPESGPGTSTEPSEGSAPGTSESATPESGPGSEPATS GSETPGTSTEPSEGSAPGTSTEPSEGSAPGTSESATPESGPGTSESATPESGPGSPAGSP TSTEEGTSESATPESGPGSEPATSGSETPGTSESATPESGPGTSTEPSEGSAPGTSTEPS EGSAPGTSTEPSEGSAPGTSTEPSEGSAPGTSTEPSEGSAPGSPAGSP TSTEEGTSTEPSEGSAPGTSESATPESGPGSEPATSGSETPGTSESATPESGPGSEPATS GSETPGTSESATPESGPGTSTEPSEGSAPGTSESATPESGPGSPAGSPTSTEEGSPAGSP TSTEEGSPAGSPTSTEEGTSESATPESGPGTSTEPSEGSAPG | 849 |
| aEGRF_VHH-Linker_AE42-aEGRF_VHH-AM875 | EVQLQESGGGLVQAGDSLRLSCLVSGRSFNSYTMGWFRQAPGKEREFVAAILWSGP TTYYADSVKGRFTISRDNAKNTVYLQMNSLKPEDTAVYYCAAALGVLVLAPGNVY SYWGQGTQVTVSSAHHGGAPGTSESATPESGPGSEPATSGSETPGTSTEPSEGSAPG PAGEVQLQESGGGLVQAGDSLRLSCLVSGRSFNSYTMGWFRQAPGKEREFVAAIL WSGPTTYYADSVKGRFTISRDNAKNTVYLQMNSLKPEDTAVYYCAAALGVLVLAP GNVYSYWGQGTQVTVSSAHHGGSTSTEPSEGSAPGSEPATSGSETPGSPAGSPTSTEE GSTSSTAESPGPGTSTPESGSASPGSTSESPSGTAPGSTSESPSGTAPGSTSPSGSASP GTSTPESGSASPGSEPATSGSETPGTSESATPESGPGSPAGSPTSTEEGTSTEPSEGSAP GTSESATPESGPGTSTEPSEGSAPGTSTEPSEGSAPGSPAGSPTSTEEGTSTEPSEGSAP GTSTEPSEGSAPGTSESATPESGPGTSESATPESGPGTSTEPSEGSAPGTSTEPSEGSAP GTSESATPESGPGTSTEPSEGSAPGSEPATSGSETPGSPAGSPTSTEEGSSTPSGATGSP GTPGSGTASSSPGSSTPSGATGSPGTSTEPSEGSAPGTSTEPSEGSAPGSEPATSGSETP GSPAGSPTSTEEGSPAGSPTSTEEGTSTEPSEGSAPGASASGAPSTGGTSESATPESGP GSPAGSPTSTEEGSPAGSPTSTEEGTSSTAESPGPGTSTPSGESSTAPG GTPGSGTASSSPGSSTPSGATGSPGSSPASTGTGPGSEPATSGSETPGTSESATPESGP GSEPATSGSETPGTSSTAESPGPGTSSTAESPGPGTSPSGESSTAPGSEPATSGSETP GSEPATSGSETPGTSTEPSEGSAPGSSTAESPGPGTSTPESGSASPGSTSESPSGTAP GTSTEPSEGSAPGTSTEPSEGSAPGTSTEPSEGSAPGSSTPSGATGSPGSSPSASTGTGP GASPGTSSTGSPGSEPATSGSETPGTSESATPESGPGSPAGSPTSTEEGSSTPSGATGSP | 850 |

TABLE 40-continued

Binding fusion proteins with targeting moieties to single targets

| Name* | Protein Sequence | SEQ ID NO: |
|---|---|---|
| | GSSPSASTGTGPGASPGTSSTGSPGTSESATPESGPGTSTEPSEGSAPGTSTEPSEGSAPG | |
| aEGRF_VHH-Linker_AM150-aEGRF_VHH-AM1296 | EVQLQESGGGLVQAGDSLRLSCLVSGRSFNSYTMGWFRQAPGKEREFVAAILWSGP TTYYADSVKGRFTISRDNAKNTVYLQMNSLKPEDTAVYYCAAALGVLVLAPGNVY SYWGQGTQVTVSSAHHGGAPSTGGTSESATPESGPGTSTEPSEGSAPGTSTEPSEGS APGTSESATPESGPGTSTEPSEGSAPGTSTEPSEGSAPGTSESATPESGPGTSTEPSEGS APGTSTEPSEGSAPGTSTEPSEGSAPGSPAGSPTSEEGTSTEPSEGSAPGPEPTGPAG EVQLQESGGGLVQAGDSLRLSCLVSGRSFNSYTMGWFRQAPGKEREFVAAILWSGP TTYYADSVKGRFTISRDNAKNTVYLQMNSLKPEDTAVYYCAAALGVLVLAPGNVY SYWGQGTQVTVSSAHHGGTSTEPSEGSAPGSEPATSGSETPGSPAGSPTSTEEGSTSS TAESPGPGTSTPESGSASPGSTSESPSGTAPGSTSESPSGTAPGTSTPESGSASPGTSTP ESGSASPGSEPATSGSETPGTSESATPESGPGSPAGSPTSTEEGTSTEPSEGSAPGTSES ATPESGPGTSTEPSEGSAPGTSTEPSEGSAPGSPAGSPTSTEEGTSTEPSEGSAPGTSTE PSEGSAPGTSESATPESGPGTSESATPESGPGTSTEPSEGSAPGTSTEPSEGSAPGTSES ATPESGPGTSTEPSEGSAPGSEPATSGSETPGSPAGSPTSTEEGSSTPSGATGSPGTPGS GTASSSPGSSTPSGATGSPGTSTEPSEGSAPGTSTEPSEGSAPGSEPATSGSETPGSPA GSPTSTEEGSPAGSPTSTEEGTSTEPSEGSAPGPEPTGPAPSGGSEPATSGSETPGTSES ATPESGPGSPAGSPTSTEEGTSESATPESGPGSPAGSPTSTEEGSPAGSPTSTEEGSPA ATPESGPGSPAGSPTSTEEGSPAGSPTSTEEGSTSSTAESPGPGSTSESPSGTAPGTSPS GESSTAPGSTSESPSGTAPGSTSESPSGTAPGTSPSGESSTAPGTSTEPSEGSAPGTSES ATPESGPGTSESATPESGPGSEPATSGSETPGTSESATPESGPGTSESATPESGPGTSTE PSEGSAPGTSESATPESGPGTSTEPSEGSAPGTSPSGESSTAPGTSPSGESSTAPGTSPS GESSTAPGTSTEPSEGSAPGSPAGSPTSTEEGTSTEPSEGSAPGSSPSASTGTGPGSSTP SGATGSPGSSTPSGATGSPGSSTPSGATGSPGSSTPSGATGSPGASPGTSSTGSPGASA SGAPSTGGTSPSGESSTAPGSTSSTAESPGPGTSPSGESSTAPGTSESATPESGPGTSTE PSEGSAPGTSTEPSEGSAPGSSPSASTGTGPGSSTPSGATGSPGASPGTSSTGSPGTSTP ESGSASPGTSPSGESSTAPGTSPSGESSTAPGTSESATPESGPGSEPATSGSETPGTSTE PSEGSAPGTSESPSGTAPGSTSESPSGTAPGTSTPESGSASPGSPAGSPTSTEEGTSES ATPESGPGTSTEPSEGSAPGSPAGSPTSTEEGTSESATPESGPGSEPATSGSETPGSSTP SGATGSPGASPGTSSTGSPGSSTPSGATGSPGSTSESPSGTAPGTSPSGESSTAPGSTSS TAESPGPGSSTPSGATGSPGASPGTSSTGSPGTPGSGTASSSPGSPAGSPTSTEEGSPA GSPTSTEEGTSTEPSEGSAPG | 851 |

*"a" before target protein name = anti

TABLE 41

Binding fusion proteins with targeting moieties to different targets

| Name* | Protein Sequence | SEQ ID NO: |
|---|---|---|
| aHer2-Y288-aEGFR | MEDIQMTQSPSSLSASVGDRVTITCRASQDVNTAVAWYQQKPGKAPKLLIYSASFLYSGVPSRFSG SRSGTDFTLTISSLQPEDFATYYCQQHYTTPPTFGQGTKVEIKTGSGEGSEGEGGGEGSEGEGSGEG GEGEGSGTEVQLVESGGGLVQPGGSLRLSCAASGFNIKDTYIHWVRQAPGKGLEWVARIYPTNGY TRYADSVKGRFTISADTSKNTAYLQMNSLRAEDTAVYYCSRWGGDGFYAMDYWGQGTLVTVSGG EGSGEGSEGEGSEGSGEGEGSEGSGEGEGGSEGSEGEGGSEGSEGEGGSEGSEGEGSGEGSEGEGGS EGSEGEGSGEGSEGEGSEGGSEGEGGSEGSEGEGSGEGSEGEGGGEGSEGEGSEGSGEGEGSGEGSE GEGSEGEGSGEGSEGEGSEGSGEGEGSEGSEGEGSEGSGEGEGGEGSGEGEGSGEGSEGEGSEGSGE GEGSEGEGGGEGSEGEGSGEGGEGSEGGSEGEGSEGGEGEGSEGSGEGEGSEGGSEGEGSEGGS EGEGSEGSGEGEGSEGSGEGEDILLTQSPVILSVSPGERVSFSCRASQSIGTNIHWYQQRTNGSPRLL IKYASESISGIPSRFSGSGSGTDFTLSINSVESEDIADYYCQQNNNWPTTFGAGTKLELKTGSGEGSE GEGGGEGSEGEGSGEGGEGEGSGTQVQLKQSGPGLVQPSQSLSITCTVSGFSLTNYGVHWVRQSPG KGLEWLGVIWSGGNTDYNTPFTSRLSINKDNSKSQVFFKMNSLQSNDTAIYYCARALTYYDYEFA YWGQGTLVTVS | 852 |
| aHer2-Y288-aCD3 | MEDIQMTQSPSSLSASVGDRVTITCRASQDVNTAVAWYQQKPGKAPKLLIYSASFLYSGVPSRFSG SRSGTDFTLTISSLQPEDFATYYCQQHYTTPPTFGQGTKVEIKTGSGEGSEGEGGGEGSEGEGSGEG GEGEGSGTEVQLVESGGGLVQPGGSLRLSCAASGFNIKDTYIHWVRQAPGKGLEWVARIYPTNGY TRYADSVKGRFTISADTSKNTAYLQMNSLRAEDTAVYYCSRWGGDGFYAMDYWGQGTLVTVSGS PGEGSGEGSEGEGSEGSGEGEGSEGGSEGEGGEGSEGEGSGEGSEGEGGSEGEGGSEGEGSEGSEGEG GSEGSEGEGGSGEGSGEGEGSEGGSEGEGSGEGSEGSEGGSEGSEGGSGEGSGEGEGSGEGSEGEGSGEG SEGEGSEGSGEGEGSEGSEGEGSEGSGEGSEGGSGEGEGSGEGSEGGSGEGSEGEGSEGSGEGEGSGEGE GSGEGSEGEGGGEGSEGEGSGEGGEGSEGGSEGEGSEGGEGEGSEGSGEGEGSEGGSEGEGSEG GSGEGSEGEGSGEGSGEGGSSSLEGTKDIQMTQSPSSLSASVGDRVTITCSASSSVSYMNWYQQ TPGKAPKRWIYDTSKLASGVPSRFSGSGSGTDYTFTISSLQPEDIATYYCQQWSSNPFTFGQGTKL QITRTGSGEGSEGEGGGEGSEGEGSGEGGEGEGSGTQVQLVQSGGGVVQPGRSLRLSCKASGYTFT RYTMHWVRQAPGKGLEWIGYINPSRGYTNYNQKFKDRFTISTDKSKSTAFLQMDSLRPEDTAVY YSARYYDDHYCLDYWGQGTPVTVSSTSG | 853 |

TABLE 41-continued

Binding fusion proteins with targeting moieties to different targets

| Name* | Protein Sequence | SEQ ID NO: |
|---|---|---|
| aCD3_VL_1-AE48-aCD3_VH-AE144-aHer2_VL-AE48-aHer2_VH-AE864 | MKDIQMTQSPSSLSASVGDRVTITCSASSSVSYMNWYQQTPGKAPKRWIYDTSKLASGV PSRFSGSGSGTDYTFTISSLQPEDIATYYCQQWSSNPFTFGQGTKLQITRGMAEPAGSPTS TEEGTPGSGTASSSPGSSTPSGATGSPGASPGTSSTGSPGQVQLVQSGGGVVQPGRSLRLS CKASGYTFTRYTMHWVRQAPGKGLEWIGYINPSRGYTNYNQKFKDRFTISTDKSKSTAF LQMDSLRPEDTAVYYCSARYYDDHYCLDYWGQGTPVTVSSGGSEPATSGSETPGTSESA TPESGPGSEPATSGSETPGSPAGSPTSTEEGTSTEPSEGSAPGSEPATSGSETPGSEPATSGS ETPGSEPATSGSETPGTSTEPSEGSAPGTSESATPESGPGSEPATSGSETPGTSTEPSEGSAP GMEDIQMTQSPSSLSASVGDRVTITCRASQDVNTAVAWYQQKPGKAPKLLIYSASFLYS GVPSRFSGSRSGTDFTLTISSLQPEDFATYYCQQHYTTPPTFGQGTKVEIKGMAEPAGSPT STEEGTPGSGTASSSPGSSTPSGATGSPGASPGTSSTGSPGEVQLVESGGGLVQPGGSLRL SCAASGFNIKDTYIHWVRQAPGKGLEWVARIYPTNGYTRYADSVKGRFTISADTSKNTA YLQMNSLRAEDTAVYYCSRWGGDGFYAMDYWGQGTLVTVSGGSPAGSPTSTEEGTSE SATPESGPGTSTEPSEGSAPGSPAGSPTSTEEGTSTEPSEGSAPGTSTEPSEGSAPGTSESAT PESGPGSEPATSGSETPGSEPATSGSETPGSPAGSPTSTEEGTSESATPESGPGTSTEPSEGS APGTSTEPSEGSAPGSPAGSPTSTEEGTSTEPSEGSAPGTSTEPSEGSAPGTSESATPESGPG TSTEPSEGSAPGTSESATPESGPGSEPATSGSETPGTSTEPSEGSAPGTSTEPSEGSAPGTSE SATPESGPGTSESATPESGPGSPAGSPTSTEEGTSESATPESGPGSEPATSGSETPGTSESAT PESGPGTSTEPSEGSAPGTSTEPSEGSAPGTSTEPSEGSAPGTSESATPESGPGTSTEPSEGS APGTSTEPSEGSAPGSPAGSPTSTEEGTSTEPSEGSAPGTSESATPESGPGSEPATSGSETPG TSESATPESGPGSEPATSGSETPGTSESATPESGPGTSTEPSEGSAPGTSESATPESGPGSPA GSPTSTEEGSPAGSPTSTEEGSPAGSPTSTEEGTSESATPESGPGTSTEPSEGSAPGTSESAT PESGPGSEPATSGSETPGTSESATPESGPGSEPATSGSETPGTSESATPESGPGTSTEPSEGS APGSPAGSPTSTEEGTSESATPESGPGSEPATSGSETPGTSESATPESGPGSPAGSPTSTEEG SPAGSPTSTEEGTSTEPSEGSAPGTSESATPESGPGTSESATPESGPGSESATPESGPGSEP ATSGSETPGSEPATSGSETPGSPAGSPTSTEEGTSTEPSEGSAPGTSTEPSEGSAPGSEPATS GSETPGTSESATPESGPGTSTEPSEGSAPG | 854 |
| aCD3_VH-AE48-aCD3_VL-AE144-aHer2_VH-AE48-aHer2_VL-AE864 | QVQLVQSGGGVVQPGRSLRLSCKASGYTFTRYTMHWVRQAPGKGLEWIGYINPSRGYT NYNQKFKDRFTISTDKSKSTAFLQMDSLRPEDTAVYYCSARYYDDHYCLDYWGQGTPVT VSSGMAEPAGSPTSTEEGTPGSGTASSSPGSSTPSGATGSPGASPGTSSTGSPGMKDIQMT QSPSSLSASVGDRVTITCSASSSVSYMNWYQQTPGKAPKRWIYDTSKLASGVPSRFSGSG SGTDYTFTISSLQPEDIATYYCQQWSSNPFTFGQGTKLQITRGGMAEPAGSPTSTEEGTPGSGT TPESGPGSEPATSGSETPGSPAGSPTSTEEGTSTEPSEGSAPGSEPATSGSETPGSEPATSGS ETPGSEPATSGSETPGTSTEPSEGSAPGTSESATPESGPGSEPATSGSETPGTSTEPSEGSAP GEVQLVESGGGLVQPGGSLRLSCAASGFNIKDTYIHWVRQAPGKGLEWVARIYPTNGY TRYADSVKGRFTISADTSKNTAYLQMNSLRAEDTAVYYCSRWGGDGFYAMDYWGQG TLVTVSGMAEPAGSPTSTEEGTPGSGTASSSPGSSTPSGATGSPGASPGTSSTGSPGMEDI QMTQSPSSLSASVGDRVTITCRASQDVNTAVAWYQQKPGKAPKLLIYSASFLYSGVPSR FSGSRSGTDFTLTISSLQPEDFATYYCQQHYTTPPTFGQGTKVEIKGGSPAGSPTSTEEGT SESATPESGPGTSTEPSEGSAPGSPAGSPTSTEEGTSTEPSEGSAPGTSTEPSEGSAPGTSES ATPESGPGSEPATSGSETPGSEPATSGSETPGSPAGSPTSTEEGTSESATPESGPGTSTEPSE GSAPGTSTEPSEGSAPGSPAGSPTSTEEGTSTEPSEGSAPGTSTEPSEGSAPGTSESATPESG PGTSTEPSEGSAPGTSESATPESGPGSEPATSGSETPGTSTEPSEGSAPGTSTEPSEGSAPGT SESATPESGPGTSESATPESGPGSPAGSPTSTEEGTSESATPESGPGSEPATSGSETPGTSES ATPESGPGTSTEPSEGSAPGTSTEPSEGSAPGTSTEPSEGSAPGTSESATPESGPGTSTEPSE GSAPGTSTEPSEGSAPGSPAGSPTSTEEGTSTEPSEGSAPGTSESATPESGPGSEPATSGSET PGTSESATPESGPGSEPATSGSETPGTSESATPESGPGTSTEPSEGSAPGTSESATPESGPGS PAGSPTSTEEGSPAGSPTSTEEGSPAGSPTSTEEGTSESATPESGPGSEPATSGSETPGTSES ATPESGPGSEPATSGSETPGTSESATPESGPGTSTEPSE GSAPGSPAGSPTSTEEGTSESATPESGPGSEPATSGSETPGTSESATPESGPGSPAGSPTSTE EGSPAGSPTSTEEGTSTEPSEGSAPGTSESATPESGPGTSESATPESGPGTSESATPESGPGS EPATSGSETPGSEPATSGSETPGSPAGSPTSTEEGTSTEPSEGSAPGTSTEPSEGSAPGSEPA TSGSETPGTSESATPESGPGTSTEPSEGSAPG | 855 |
| aHer2_VL-AM48-aHer2_VH-AF144-aCD3_VL-AM48-aCD3_VH-AM1296 | MEDIQMTQSPSSLSASVGDRVTITCRASQDVNTAVAWYQQKPGKAPKLLIYSASFLYSG VPSRFSGSRSGTDFTLTISSLQPEDFATYYCQQHYTTPPTFGQGTKVEIKGMAEPAGSPTS TEEGASPGTSSTPSGSSTPSGATGSPGSSPTSGATGSPGEVQLVESGGGLVQPGGSLRLS CAASGFNIKDTYIHWVRQAPGKGLEWVARIYPTNGYTRYADSVKGRFTISADTSKNTA YLQMNSLRAEDTAVYYCSRWGGDGFYAMDYWGQGTLVTVSGGTSTPESGSASPGTSP SGESSTAPGTSPSGESSTAPGTSSTAESPGPGSTSESPSGTAPGSTSSTAESPGPGTSPSGE SSTAPGTSTPESGSASPGSTSSTAESPGPGSTSPSGESSTAPGTSPSGESSTAPGTSPSGESST APGMKDIQMTQSPSSLSASVGDRVTITCSASSSVSYMNWYQQTPGKAPKRWIYDTSKLA SGVPSRFSGSGSGTDYTFTISSLQPEDIATYYCQQWSSNPFTFGQGTKLQITRGMAEPAGS PTSTEEGASPGTSSTGSPGSSTPSGATGSPGSSTPSGATGSPGQVQLVQSGGGVVQPGRSL RLSCKASGYTFTRYTMHWVRQAPGKGLEWIGYINPSRGYTNYNQKFKDRFTISTDKSKS TAFLQMDSLRPEDTAVYYCSARYYDDHYCLDYWGQGTPVTVSSGGTSTEPSEGSAPGSE PATSGSETPGSPAGSPTSTEEGSTSSTAESPGPGTSTPESGSASPGSTSESPSGTAPGSTSES PSGTAPGTSTPESGSASPGSEPATSGSETPGTSESATPESGPGSPAGSPTSTEEGTSESATPESGPGSPAGSPTSTEE GTSTEPSEGSAPGTSTEPSEGSAPGTSESATPESGPGTSESATPESGPGTSTEPSEGSAPGTS TEPSEGSAPGTSESATPESGPGTSTEPSEGSAPGSEPATSGSETPGSPAGSPTSTEEGSSTPS GATGSPGTPGSGTASSSPGSSTPSGATGSPGTSTEPSEGSAPGTSTEPSEGSAPGSEPATSG SETPGSPAGSPTSTEEGSPAGSPTSTEEGTSTEPSEGSAPGPEPTGPAPSGGSEPATSGSETP GTSESATPESGPGSPAGSPTSTEEGTSESATPESGPGSPAGSPTSTEEGSPAGSPTSTEEGTS | 856 |

TABLE 41-continued

Binding fusion proteins with targeting moieties to different targets

| Name* | Protein Sequence | SEQ ID NO: |
|---|---|---|
| | ESATPESGPGSPAGSPTSTEEGSPAGSPTSTEEGSTSSTAESPGPGSTSESPSGTAPGTSPSG<br>ESSTAPGSTSESPSGTAPGSTSESPSGTAPGTSPSGESSTAPGTSTEPSEGSAPGTSESATPE<br>SGPGTSESATPESGPGSEPATSGSETPGTSESATPESGPGTSESATPESGPGTSTEPSEGSAP<br>GTSESATPESGPGSTEPSEGSAPGTSPSGESSTAPGTSPSGESSTAPGTSPSGESSTAPGTS<br>TEPSEGSAPGSPAGSPTSTEEGTSTEPSEGSAPGSSPSASTGTGPGSSTPSGATGSPGSSTPS<br>GATGSPGSSTPSGATGSPGSSTPSGATGSPGASPGTSSTGSPGASASGAPSTGGTSPSGESS<br>TAPGSTSSTAESPGPGTSPSGESSTAPGTSESATPESGPGTSTEPSEGSAPGTSTEPSEGSAP<br>GSSPSASTGTGPGSSTPSGATGSPGASPGTSSTGSPGTSTPESGSASPGTSPSGESSTAPGTS<br>PSGESSTAPGTSESATPESGPGSEPATSGSETPGTSTEPSEGSAPGSTSESPSGTAPGSTSES<br>PSGTAPGTSTPESGSASPGSPAGSPTSTEEGTSESATPESGPGTSTEPSEGSAPGSPAGSPTS<br>TEEGTSESATPESGPGSEPATSGSETPGSSTPSGATGSPGSSTPSGATGSPGSSTPSGATGSP<br>GSTSESPSGTAPGTSPSGESSTAPGSTSSTAESPGPGSSTPSGATGSPGASPGTSSTGSPGTP<br>GSGTASSSPGSPAGSPTSTEEGSPAGSPTSTEEGTSTEPSEGSAPG | |
| aHer2_VH-<br>AM48-<br>aHer2_VL-<br>AF144-<br>aCD3_VH-<br>AM48-<br>aCD3_VL-<br>AM875 | EVQLVESGGGLVQPGGSLRLSCAASGFNIKDTYIHWVRQAPGKGLEWVARIYPTNGYT<br>RYADSVKGRFTISADTSKNTAYLQMNSLRAEDTAVYYCSRWGGDGFYAMDYWGQGT<br>LVTVSGMAEPAGSPTSTEEGASPGTSSTGSPGSSTPSGATGSPGSSTPSGATGSPGMEDIQ<br>MTQSPSSLSASVGDRVTITCRASQDVNTAVAWYQQKPGKAPKLLIYSASFLYSGVPSRF<br>SGSRSGTDFTLTISSLQPEDFATYYCQQHYTTPPTFGQGTKVEIKGGTSTPESGSASPGTSP<br>SGESSTAPGTSPSGESSTAPGSTSSTAESPGPGSTSESPSGTAPGSTSSTAESPGPGTSPSGE<br>SSTAPGTSPESGSASPGSTSSTAESPGPGTSPSGESSTAPGTSPSGESSTAPGTSPSGESST<br>APGQVQLVQSGGGVVQPGRSLRLSCKASGYTFTRYTMHWVRQAPGKGLEWIGYINPSR<br>GYTNYNQKFKDRFTISTDKSKSTAFLQMDSLRPEDTAVYYSARYYDDHYCLDYWGQG<br>TPVTVSSGMAEPAGSPTSTEEGASPGTSSTGSPGSSTPSGATGSPGSSTPSGATGSPGMKD<br>IQMTQSPSSLSASVGDRVTITCSASSSVSYMNWYQQTPGKAPKRWIYDTSKLASGVPSRF<br>SGSGSGTDYTFTISSLQPEDIATYYCQQWSSNPFTFGQGTKLQITRGGTSTEPSEGSAPGS<br>EPATSGSETPGSPAGSPTSTEEGSTSSTAESPGPAGSTSESPSGTAPGTSTPESGSASPGSTSESPSGTAPGSTSE<br>SPSGTAPGTSTPESGSASPGTSTPESGSASPGSEPATSGSETPGTSESATPESGPGSPAGSPT<br>STEEGTSTEPSEGSAPGTSESATPESGPGTSTEPSEGSAPGTSTEPSEGSAPGSPAGSPTSTE<br>EGTSTEPSEGSAPGTSTEPSEGSAPGTSESATPESGPGTSESATPESGPGTSTEPSEGSAPGT<br>STEPSEGSAPGTSESATPESGPGTSTEPSEGSAPGSEPATSGSETPGSPAGSPTSTEEGSSTP<br>SGATGSPGTPGSGTASSSPGSSTPSGATGSPGTSTEPSEGSAPGTSTEPSEGSAPGSEPATS<br>GSETPGSPAGSPTSTEEGSPAGSPTSTEEGTSTEPSEGSAPGASASGAPSTGGTSESATPES<br>GPGSPAGSPTSTEEGSPAGSPTSTEEGSTSSTAESPGPGSTSESPSGTAPGTSPSGESSTAPG<br>TPGSGTASSSPGSSTPSGATGSPGSSPSASTGTGPGSEPATSGSETPGTSESATPESGPGSEP<br>ATSGSETPGTSSTAESPGPGTSSTAESPGPGTSPSGESSTAPGSEPATSGSETPGSEPATS<br>GSETPGTSTEPSEGSAPGTSSTAESPGPGTSPESGSASPGTSESPSGTAPGTSTEPSEGS<br>APGTSTEPSEGSAPGTSTEPSEGSAPGSSTPSGATGSPGSSPSASTGTGPGASPGTSSTGSP<br>GSEPATSGSETPGTSESATPESGPGSPAGSPTSTEEGSSTPSGATGSPGSSPSASTGTGPGA<br>SPGTSSTGSPGTSESATPESGPGTSTEPSEGSAPGTSTEPSEGSAPG | 857 |
| aHer2_VL-<br>Linker_AE42-<br>aHer2_VH-<br>AE288-<br>aEGFR_VL-<br>Linker_AM150-<br>aEGFR_VH-<br>AD576 | MEDIQMTQSPSSLSASVGDRVTITCRASQDVNTAVAWYQQKPGKAPKLLIYSASFLYSG<br>VPSRFSGSRSGTDFTLTISSLQPEDFATYYCQQHYTTPPTFGQGTKVEIKGGAPGTSESAT<br>PESGPGSEPATSGSETPGTSTEPSEGSAPGPAGEVQLVESGGGLVQPGGSLRLSCAASGFN<br>IKDTYIHWVRQAPGKGLEWVARIYPTNGYTRYADSVKGRFTISADTSKNTAYLQMNSL<br>RAEDTAVYYCSRWGGDGFYAMDYWGQGTLVTVSGGTSESATPESGPGSEPATSGSETP<br>GTSESATPESGPGSEPATSGSETPGTSESATPESGPGTSTEPSEGSAPGSPAGSPTSTEEGTS<br>ESATPESGPGSEPATSGSETPGTSESATPESGPGSPAGSPTSTEEGSPAGSPTSTEEGTSTEP<br>SEGSAPGTSESATPESGPGTSESATPESGPGTSESATPESGPGSEPATSGSETPGSEPATSGS<br>ETPGSPAGSPTSTEEGTSTEPSEGSAPGTSTEPSEGSAPGSEPATSGSETPGTSESATPESGP<br>GTSTEPSEGSAPGMEDILLLTQSPVILSVSPGERVSFSCRASQSIGTNIHWYQQRTNGSPRLL<br>IKYASESISGIPSRFSGSGSGTDFTLSINSVESEDIADYYCQQNNNWPTTFGAGTKLELKG<br>GAPSTGGTSESATPESGPGTSTEPSEGSAPGTSTEPSEGSAPGTSESATPESGPGTSTEPSE<br>GSAPGTSTEPSEGSAPGTSESATPESGPGTSTEPSEGSAPGTSTEPSEGSAPGTSTEPSEGSA<br>PGSPAGSPTSTEEGTSTEPSEGSAPGPEPTGPAGQVQLKQSGPGLVQPSQSLSITCTVSGFS<br>LTNYGVHWVRQSPGKGLEWLGVIWSGGNTDYNTPFTSRLSINKDNSKSQVFFKMNSLQ<br>SNDTAIYYCARALTYYDYEFAYWGQGTLVTVSGGSSESGSSEGGPGSSGGEPSESGSSGS<br>SESGSSEGGPGSSESGSSEGGPGSSESGSSEGGPGSSESGSSEGGPGSESGSSEGGPGESP<br>GGSSGSESGSEGSSGPGESSGSSESGSSEGGPGSSESGSSEGGPGSSESGSSEGGPGSGGEP<br>SESGSSGESPGGSSGSESGESPGGSSGSESGSGGEPSESGSSGSSESGSSEGGPGSGGEPSES<br>GSSGGEPSESGSSGSSESGSSEGGPGESPGGSSGSESGESPGGSSGSESGESPGGSSGSESG<br>ESPGGSSGESGESPGGSSGSESGSSESGSSEGGPGSGGEPSESGSSGSEGSSGPGESSGSSE<br>SGSSEGGPGSGGEPSESGSSGSSESGSSEGGPGSGGEPSESGSSGESPGGSSGSESGESPGG<br>SSGSESGSSESGSSEGGPGSGGEPSESGSSGSSESGSSEGGPGSGGEPSESGSSGSGGEPSES<br>GSSGESPGGSSGSESGSEGSSGPGESSGSSESGSSEGGPGSEGSSGPGESSG | 858 |
| aHer2_VH-<br>Linker_AM150-<br>aHer2_VL-<br>AE288-<br>aEGFR_VH- | EVQLVESGGGLVQPGGSLRLSCAASGFNIKDTYIHWVRQAPGKGLEWVARIYPTNGYT<br>RYADSVKGRFTISADTSKNTAYLQMNSLRAEDTAVYYCSRWGGDGFYAMDYWGQGT<br>LVTVSGGAPSTGGTSESATPESGPGTSTEPSEGSAPGTSTEPSEGSAPGTSESATPESGPGT<br>STEPSEGSAPGTSTEPSEGSAPGTSESATPESGPGTSTEPSEGSAPGTSTEPSEGSAPGTSTE<br>PSEGSAPGSPAGSPTSTEEGTSTEPSEGSAPGPEPTGPAGMEDIQMTQSPSSLSASVGDRV | 859 |

TABLE 41-continued

Binding fusion proteins with targeting moieties to different targets

| Name* | Protein Sequence | SEQ ID NO: |
|---|---|---|
| Linker_AE42-aEGFR_VL-AE576 | TITCRASQDVNTAVAWYQQKPGKAPKLLIYSASFLYSGVPSRFSGSRSGTDFTLTISSLQP EDFATYYCQQHYTTPPTFGQGTKVEIKGGTSESATPESGPGSEPATSGSETPGTSESATPE SGPGSEPATSGSETPGTSESATPESGPGTSTEPSEGSAPGSPAGSPTSTEEGTSESATPESGP GSEPATSGSETPGTSESATPESGPGSPAGSPTSTEEGSPAGSPTSTEEGTSTEPSEGSAPGTS ESATPESGPGTSESATPESGPGTSESATPESGPGSEPATSGSETPGSEPATSGSETPGSPAGS PTSTEEGTSTEPSEGSAPGTSTEPSEGSAPGSEPATSGSETPGTSESATPESGPGTSTEPSEG SAPGQVQLKQSGPGLVQPSQSLSITCTVSGFSLTNYGVHWVRQSPGKGLEWLGVIWSGG NTDYNTPFTSRLSINKDNSKSQVFFKMNSLQSNDTAIYYCARALTYYDYEFAYWGQGT LVTVSGGAPGTSESATPESGPGSEPATSGSETPGTSTEPSEGSAPGPAGMEDILLTQSPVIL SVSPGERVSFSCRASQSIGTNIHWYQQRTNGSPRLLIKYASESISGIPSRFSGSGSGTDFTLS INSVESEDIADYYCQQNNNWPTTFGAGTKLELKGGSPAGSPTSTEEGTSESATPESGPGT STEPSEGSAPGSPAGSPTSTEEGTSTEPSEGSAPGTSTEPSEGSAPGTSESATPESGPGSEPA TSGSETPGSEPATSGSETPGSPAGSPTSTEEGTSESATPESGPGTSTEPSEGSAPGTSTEPSE GSAPGSPAGSPTSTEEGTSTEPSEGSAPGTSTEPSEGSAPGTSESATPESGPGTSTEPSEGSA PGTSESATPESGPGSEPATSGSETPGTSTEPSEGSAPGTSESATPESGPGTSESATPESGPGT SESATPESGPGSPAGSPTSTEEGTSESATPESGPGSEPATSGSETPGTSESATPESGPGTSTE PSEGSAPGTSTEPSEGSAPGTSTEPSEGSAPGTSTEPSEGSAPGTSTEPSEGSAPGTSTEPSE GSAPGSPAGSPTSTEEGTSTEPSEGSAPGTSESATPESGPGSEPATSGSETPGTSESATPESG PGSEPATSGSETPGTSESATPESGPGTSTEPSEGSAPGTSESATPESGPGSPAGSPTSTEEGS PAGSPTSTEEGTSESATPESGPGTSTEPSEGSAPG | |
| AE624-aHer2_VL-Linker_AE42-aHer2_VH-AE288-aEGFR_VL-Linker_AM150-aEGFR_VH | MAEPAGSPTSTEEGTPGSGTASSSPGSSTPSGATGSPGASPGTSSTGSPGSPAGSPTSTEEG TSESATPESGPGTSTEPSEGSAPGSPAGSPTSTEEGTSTEPSEGSAPGTSTEPSEGSAPGTSE SATPESGPGSEPATSGSETPGSEPATSGSETPGSPAGSPTSTEEGTSESATPESGPGTSTEPS EGSAPGTSTEPSEGSAPGSPAGSPTSTEEGTSTEPSEGSAPGTSTEPSEGSAPGTSESATPES GPGTSTEPSEGSAPGTSESATPESGPGSEPATSGSETPGTSTEPSEGSAPGTSTEPSEGSAPG TSESATPESGPGTSESATPESGPGSPAGSPTSTEEGTSESATPESGPGSEPATSGSETPGTSE SATPESGPGTSTEPSEGSAPGTSTEPSEGSAPGTSTEPSEGSAPGTSTEPSEGSAPGTSTEPS EGSAPGTSTEPSEGSAPGSPAGSPTSTEEGTSTEPSEGSAPGTSESATPESGPGSEPATSGSE TPGTSESATPESGPGSEPATSGSETPGTSESATPESGPGTSTEPSEGSAPGTSESATPESGPG SPAGSPTSTEEGSPAGSPTSTEEGTSTEPSEGSAPGTSESATPESGPGTSTEPSEGSAPGME DIQMTQSPSSLSASVGDRVTITCRASQDVNTAVAWYQQKPGKAPKLLIYSASFLYSGVP SRFSGSRSGTDFTLTISSLQPEDFATYYCQQHYTTPPTFGQGTKVEIKGGAPGTSESATPE SGPGSEPATSGSETPGTSTEPSEGSAPGPAGEVQLVESGGGLVQPGGSLRLSCAASGFNIK DTYIHWVRQAPGKGLEWVARIYPTNGYTRYADSVKGRFTISADTSKNTAYLQMNSLRA EDTAVYYCSRWGGDGFYAMDYWGQGTLVTVSGGTSESATPESGPGSEPATSGSETPGT SESATPESGPGSEPATSGSETPGTSESATPESGPGTSTEPSEGSAPGSPAGSPTSTEEGTSES ATPESGPGSEPATSGSETPGTSESATPESGPGSPAGSPTSTEEGSPAGSPTSTEEGTSTEPSE GSAPGTSESATPESGPGTSESATPESGPGSEPATSGSETPGSEPATSGSET PGSPAGSPTSTEEGTSTEPSEGSAPGSEPATSGSETPGTSESATPESGPGT STEPSEGSAPGMEDILLTQSPVILSVSPGERVSFSCRASQSIGTNIHWYQQRTNGSPRLLIK YASESISGIPSRFSGSGSGTDFTLSINSVESEDIADYYCQQNNNWPTTFGAGTKLELKGGA PSTGGTSESATPESGPGTSTEPSEGSAPGTSTEPSEGSAPGTSESATPESGPGTSTEPSEGSA PGTSTEPSEGSAPGTSESATPESGPGTSTEPSEGSAPGTSTEPSEGSAPGTSTEPSEGSAPG PAGSPTSTEEGTSTEPSEGSAPGPEPTGPAGQVQLKQSGPGLVQPSQSLSITCTVSGFSLTN YGVHWVRQSPGKGLEWLGVIWSGGNTDYNTPFTSRLSINKDNSKSQVFFKMNSLQSND TAIYYCARALTYYDYEFAYWGQGTLVTVSG | 860 |
| AE912-aHer2_VH-Linker_AM150-aHer2_VL-AE288-aEGFR_VH-Linker_AE42-aEGFR_VL | MAEPAGSPTSTEEGTPGSGTASSSPGSSTPSGATGSPGASPGTSSTGSPGSPAGSPTSTEEG TSESATPESGPGTSTEPSEGSAPGSPAGSPTSTEEGTSTEPSEGSAPGTSTEPSEGSAPGTSE SATPESGPGSEPATSGSETPGSEPATSGSETPGSPAGSPTSTEEGTSESATPESGPGTSTEPS EGSAPGTSTEPSEGSAPGSPAGSPTSTEEGTSTEPSEGSAPGTSTEPSEGSAPGTSESATPES GPGTSTEPSEGSAPGTSESATPESGPGSEPATSGSETPGTSTEPSEGSAPGTSTEPSEGSAPG TSESATPESGPGTSESATPESGPGSPAGSPTSTEEGTSESATPESGPGSEPATSGSETPGTSE SATPESGPGTSTEPSEGSAPGTSTEPSEGSAPGTSTEPSEGSAPGTSTEPSEGSAPGTSTEPS EGSAPGTSTEPSEGSAPGSPAGSPTSTEEGTSTEPSEGSAPGTSESATPESGPGSEPATSGSE TPGTSESATPESGPGSEPATSGSETPGTSESATPESGPGTSTEPSEGSAPGTSESATPESGPG SPAGSPTSTEEGSPAGSPTSTEEGSPAGSPTSTEEGTSESATPESGPGTSTEPSEGSAPGTSE SATPESGPGSEPATSGSETPGTSESATPESGPGSEPATSGSETPGTSESATPESGPGTSTEPS EGSAPGSPAGSPTSTEEGTSESATPESGPGSEPATSGSETPGTSESATPESGPGSPAGSPTST EEGSPAGSPTSTEEGTSTEPSEGSAPGTSESATPESGPGTSESATPESGPGS EPATSGSETPGSEPATSGSETPGSPAGSPTSTEEGTSTEPSEGSAPGSEP ATSGSETPGTSESATPESGPGTSTEPSEGSAPGEVQLVESGGGLVQPGGSLRLSCAASGFN IKDTYIHWVRQAPGKGLEWVARIYPTNGYTRYADSVKGRFTISADTSKNTAYLQMNSL RAEDTAVYYCSRWGGDGFYAMDYWGQGTLVTVSGGAPSTGTSESATPESGPGTSTEP SEGSAPGTSTEPSEGSAPGTSESATPESGPGTSTEPSEGSAPGTSTEPSEGSAPGTSESATPE SGPGTSTEPSEGSAPGTSTEPSEGSAPGTSTEPSEGSAPGSPAGSPTSTEEGTSTEPSEGSAP GPEPTGPAGMEDIQMTQSPSSLSASVGDRVTITCRASQDVNTAVAWYQQKPGKAPKLLI YSASFLYSGVPSRFSGSRSGTDFTLTISSLQPEDFATYYCQQHYTTPPTFGQGTKVEIKGG TSESATPESGPGSEPATSGSETPGTSESATPESGPGSEPATSGSETPGSESATPESGPGTST EPSEGSAPGSPAGSPTSTEEGTSESATPESGPGSEPATSGSETPGTSESATPESGPGSPAGSP TSTEEGSPAGSPTSTEEGTSTEPSEGSAPGTSESATPESGPGTSESATPESGPGTSESATPES GPGSEPATSGSETPGSEPATSGSETPGSPAGSPTSTEEGTSTEPSEGSAPGTSTEPSEGSAPG SEPATSGSETPGTSESATPESGPGTSTEPSEGSAPGQVQLKQSGPGLVQPSQSLSITCTVSG | 861 |

TABLE 41-continued

Binding fusion proteins with targeting moieties to different targets

| Name* | Protein Sequence | SEQ ID NO: |
|---|---|---|
| | FSLTNYGVHWVRQSPGKGLEWLGVIWSGGNTDYNTPFTSRLSINKDNSKSQVFFKMNS<br>LQSNDTAIYYCARALTYYDYEFAYWGQGTLVTVSGGAPGTSESATPESGPGSEPATSGS<br>ETPGTSTEPSEGSAPGPAGMEDILLTQSPVILSVSPGERVSFSCRASQSIGTNIHWYQQRT<br>NGSPRLLIKYASESISGIPSRFSGSGSGTDFTLSINSVESEDIADYYCQQNNNWPTTFGAGT<br>KLELKG | |
| AM923-<br>aEGFR_VL-<br>Linker_AM150-<br>aEGFR_VH-<br>AP144-<br>aHer2_VH-<br>Linker_AM150-<br>aHer2_VL | MAEPAGSPTSTEEGASPGTSSTGSPGSSTPSGATGSPGSSTPSGATGSPGTSTEPSEGSAPG<br>SEPATSGSETPGSPAGSPTSTEEGSTSSTAESPGPGTSTPESGSASPGSTSESPSGTAPGSTS<br>ESPSGTAPGTSTPESGSASPGTSTPESGSASPGSEPATSGSETPGTSESATPESGPGSPAGSP<br>TSTEEGTSTEPSEGSAPGTSESATPESGPGTSTEPSEGSAPGTSTEPSEGSAPGSPAGSPTST<br>EEGTSTEPSEGSAPGTSTEPSEGSAPGTSESATPESGPGTSESATPESGPGTSTEPSEGSAPG<br>TSTEPSEGSAPGTSESATPESGPGTSTEPSEGSAPGSEPATSGSETPGSPAGSPTSTEEGSST<br>PSGATGSPGTPGSGTASSSPGSSTPSGATGSPGTSTEPSEGSAPGTSTEPSEGSAPGSEPAT<br>SGSETPGSPAGSPTSTEEGSPAGSPTSTEEGTSTEPSEGSAPGASASGAPSTGGTSESATPE<br>SGPGSPAGSPTSTEEGSPAGSPTSTEEGSTSSTAESPGPGSTSESPSGTAPGTSPSGESSTAP<br>GTPGSGTASSSPGSSTPSGATGSPGSSPSASTGTGPGSEPATSGSETPGTSESATPESGPGS<br>EPATSGSETPGSTSSTAESPGPGSTSSTAESPGPGTSPSGESSTAPGSEPATSGSETPGSEPA<br>TSGSETPGTSTEPSEGSAPGSTSSTAESPGPGTSTPESGSASPGSTSESPSGTAPGTSTEPSE<br>GSAPGTSTEPSEGSAPGTSTEPSEGSAPGSSTPSGATGSPGSSPSASTGTGPGASPGTSSTG<br>SPGSEPATSGSETPGTSESATPESGPGSPAGSPTSTEEGSSTPSGATGSPGSSPSASTGTGPG<br>ASPGTSSTGSPGTSESATPESGPGTSTEPSEGSAPGTSTEPSEGSAPGMEDILLTQSPVILSV<br>SPGERVSFSCRASQSIGTNIHWYQQRTNGSPRLLIKYASESISGIPSRFSGSGSGTDFTLSIN<br>SVESEDIADYYCQQNNNWPTTFGAGTKLELKGGAPSTGGTSESATPESGPGTSTEPSEGS<br>APGTSTEPSEGSAPGTSESATPESGPGTSTEPSEGSAPGTSTEPSEGSAPGTSESATPESGPG<br>TSTEPSEGSAPGTSTEPSEGSAPGTSTEPSEGSAPGSPAGSPTSTEEGTSTEPSEGSAPGPEP<br>TGPAGQVQLKQSGPGLVQPSQSLSITCTVSGFSLTNYGVHWVRQSPGKGLEWLGVIWS<br>GGNTDYNTPFTSRLSINKDNSKSQVFFKMNSLQSNDTAIYYCARALTYYDYEFAYWGQ<br>GTLVTVSGGTSTPESGSASPGTSPSGESSTAPGTSPSGESSTAPGSTSSTAESPGPGSTSESP<br>SGTAPGSTSSTAESPGPGTSPSGESSTAPGTSTPESGSASPGSTSSTAESPGPGTSPSGESST<br>APGTSPSGESSTAPGTSPSGESSTAPGEVQLVESGGGLVQPGGSLRLSCAASGFNIKDTYI<br>HWVRQAPGKGLEWVARIYPTNGYTRYADSVKGRFTISADTSKNTAYLQMNSLRAEDT<br>AVYYCSRWGGDGFYAMDYWGQGTLVTVSGGAPSTGGTSESATPESGPGTSTEPSEGSA<br>PGTSTEPSEGSAPGTSESATPESGPGTSTEPSEGSAPGTSTEPSEGSAPGTSESATPESGPGT<br>STEPSEGSAPGTSTEPSEGSAPGTSTEPSEGSAPGSPAGSPTSTEEGTSTEPSEGSAPGPEPT<br>GPAGMEDIQMTQSPSSLSASVGDRVTITCRASQDVNTAVAWYQQKPGKAPKLLIYSASF<br>LYSGVPSRFSGSRSGTDFTLTISSLQPEDFATYYCQQHYTTPPTFGQGTKVEIKG | 862 |

*"a" before target moiety protein name = anti

SEQUENCE LISTING (880 sequences)

SEQ ID NO: 1 - protein, 30 aa, Artificial Sequence
  Description of Artificial Sequence: Synthetic polypeptide
GSGEGSEGEGGGEGSEGEGSGEGGEGEGSG

SEQ ID NO: 2 - protein, 12 aa, Artificial Sequence
  Description of Artificial Sequence: Synthetic peptide
GESPGGSSGSES

SEQ ID NO: 3 - protein, 12 aa, Artificial Sequence
  Description of Artificial Sequence: Synthetic peptide
GSEGSSGPGESS

SEQ ID NO: 4 - protein, 12 aa, Artificial Sequence
  Description of Artificial Sequence: Synthetic peptide
GSSESGSSEGGP

SEQ ID NO: 5 - protein, 12 aa, Artificial Sequence
  Description of Artificial Sequence: Synthetic peptide
GSGGEPSESGSS

SEQ ID NO: 6 - protein, 12 aa, Artificial Sequence
  Description of Artificial Sequence: Synthetic peptide
GSPAGSPTSTEE

SEQ ID NO: 7 - protein, 12 aa, Artificial Sequence
  Description of Artificial Sequence: Synthetic peptide
GSEPATSGSETP

SEQ ID NO: 8 - protein, 12 aa, Artificial Sequence
  Description of Artificial Sequence: Synthetic peptide
GTSESATPESGP

SEQ ID NO: 9 - protein, 12 aa, Artificial Sequence
  Description of Artificial Sequence: Synthetic peptide
GTSTEPSEGSAP

SEQ ID NO: 10 - protein, 12 aa, Artificial Sequence
  Description of Artificial Sequence: Synthetic peptide
GSTSESPSGTAP

SEQ ID NO: 11 - protein, 12 aa, Artificial Sequence
  Description of Artificial Sequence: Synthetic peptide
GTSTPESGSASP

SEQ ID NO: 12 - protein, 12 aa, Artificial Sequence
  Description of Artificial Sequence: Synthetic peptide
GTSPSGESSTAP

SEQ ID NO: 13 - protein, 12 aa, Artificial Sequence
  Description of Artificial Sequence: Synthetic peptide
GSTSSTAESPGP

SEQ ID NO: 14 - protein, 12 aa, Artificial Sequence
  Description of Artificial Sequence: Synthetic peptide
GTPGSGTASSSP

SEQ ID NO: 15 - protein, 12 aa, Artificial Sequence
  Description of Artificial Sequence: Synthetic peptide
GSSTPSGATGSP

SEQ ID NO: 16 - protein, 12 aa, Artificial Sequence
  Description of Artificial Sequence: Synthetic peptide
GSSPSASTGTGP

SEQ ID NO: 17 - protein, 12 aa, Artificial Sequence
  Description of Artificial Sequence: Synthetic peptide
GASPGTSSTGSP

SEQ ID NO: 18 - protein, 12 aa, Artificial Sequence
  Description of Artificial Sequence: Synthetic peptide
GEPAGSPTSTSE

SEQ ID NO: 19 - protein, 12 aa, Artificial Sequence
  Description of Artificial Sequence: Synthetic peptide
GTGEPSSTPASE

SEQ ID NO: 20 - protein, 12 aa, Artificial Sequence
  Description of Artificial Sequence: Synthetic peptide
GSGPSTESAPTE

SEQ ID NO: 21 - protein, 12 aa, Artificial Sequence
  Description of Artificial Sequence: Synthetic peptide
GSETPSGPSETA

SEQ ID NO: 22 - protein, 12 aa, Artificial Sequence
  Description of Artificial Sequence: Synthetic peptide
GPSETSTSEPGA

SEQ ID NO: 23 - protein, 12 aa, Artificial Sequence
  Description of Artificial Sequence: Synthetic peptide
GSPSEPTEGTSA

SEQ ID NO: 24 - protein, 12 aa, Artificial Sequence
  Description of Artificial Sequence: Synthetic peptide
GSGASEPTSTEP

SEQ ID NO: 25 - protein, 12 aa, Artificial Sequence
  Description of Artificial Sequence: Synthetic peptide
GSEPATSGTEPS

SEQ ID NO: 26 - protein, 12 aa, Artificial Sequence
  Description of Artificial Sequence: Synthetic peptide
GTSEPSTSEPGA

SEQ ID NO: 27 - protein, 12 aa, Artificial Sequence
  Description of Artificial Sequence: Synthetic peptide
GTSTEPSEPGSA

SEQ ID NO: 28 - protein, 12 aa, Artificial Sequence
  Description of Artificial Sequence: Synthetic peptide
GSTAGSETSTEA

SEQ ID NO: 29 - protein, 12 aa, Artificial Sequence
  Description of Artificial Sequence: Synthetic peptide
GSETATSGSETA

SEQ ID NO: 30 - protein, 12 aa, Artificial Sequence
  Description of Artificial Sequence: Synthetic peptide
GTSESATSESGA

SEQ ID NO: 31 - protein, 12 aa, Artificial Sequence
  Description of Artificial Sequence: Synthetic peptide
GTSTEASEGSAS

SEQ ID NO: 32 - protein, 42 aa, Artificial Sequence
  Description of Artificial Sequence: Synthetic polypeptide
TEPSEGSAPGSPAGSPTSTEEGTSESATPESGPGSEPATSGS

SEQ ID NO: 33 - protein, 42 aa, Artificial Sequence
  Description of Artificial Sequence: Synthetic polypeptide
PAGSPTSTEEGTSTEPSEGSAPGTSESATPESGPGSEPATSG

SEQ ID NO: 34 - protein, 42 aa, Artificial Sequence
  Description of Artificial Sequence: Synthetic polypeptide
SEPATSGSETPGTSESATPESGPGTSTEPSEGSAPGSPAGSP

SEQ ID NO: 35 - protein, 42 aa, Artificial Sequence
  Description of Artificial Sequence: Synthetic polypeptide
GAPSPSASTGTGPGTPGSGTASSSPGSSTPSGATGSPGPSGP

SEQ ID NO: 36 - protein, 42 aa, Artificial Sequence
  Description of Artificial Sequence: Synthetic polypeptide
GPGTPGSGTASSSPGSSTPSGATGSPGSSPSASTGTGPGASP

SEQ ID NO: 37 - protein, 42 aa, Artificial Sequence
  Description of Artificial Sequence: Synthetic polypeptide
SPSASTGTGPGASPGTSSTGSPGTPGSGTASSSPGSSTPSGA

SEQ ID NO: 38 - protein, 42 aa, Artificial Sequence
  Description of Artificial Sequence: Synthetic polypeptide
SASTGTGPGASPGTSSTGSPGTPGSGTASSSPGSSTPSGATG

SEQ ID NO: 39 - protein, 48 aa, Artificial Sequence
  Description of Artificial Sequence: Synthetic polypeptide
MAEPAGSPTSTEEGTPGSGTASSSPGSSTPSGATGSPGASPGTSSTGS

SEQ ID NO: 40 - protein, 48 aa, Artificial Sequence
  Description of Artificial Sequence: Synthetic polypeptide
MAEPAGSPTSTEEGASPGTSSTGSPGSSTPSGATGSPGSSTPSGATGS

SEQ ID NO: 41 - protein, 144 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 42 - protein, 144 aa, Artificial Sequence
  Description of Artificial Sequence: Synthetic polypeptide
GTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAP

SEQ ID NO: 43 - protein, 144 aa, Artificial Sequence
  Description of Artificial Sequence: Synthetic polypeptide
PGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSS

SEQ ID NO: 44 - protein, 144 aa, Artificial Sequence
  Description of Artificial Sequence: Synthetic polypeptide
SGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASP

SEQ ID NO: 45 - protein, 144 aa, Artificial Sequence
  Description of Artificial Sequence: Synthetic polypeptide
GTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSP

SEQ ID NO: 46 - protein, 144 aa, Artificial Sequence
  Description of Artificial Sequence: Synthetic polypeptide
GTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSP

SEQ ID NO: 47 - protein, 288 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 48 - protein, 316 aa, Artificial Sequence
  Description of Artificial Sequence: Synthetic polypeptide
ASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGS

SEQ ID NO: 49 - protein, 288 aa, Artificial Sequence
  Description of Artificial Sequence: Synthetic polypeptide
PGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGS

SEQ ID NO: 50 - protein, 288 aa, Artificial Sequence
  Description of Artificial Sequence: Synthetic polypeptide
GSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSP

SEQ ID NO: 51 - protein, 504 aa, Artificial Sequence
  Description of Artificial Sequence: Synthetic polypeptide
  MOD_RES (63)..(63): Any amino acid
  MOD_RES (207)..(207): Any amino acid
GASPGTSSTGSPGSSPSASTGTGPGSSPSASTGTGPGTPGSGTASSSPGSSTPSGATGSPGSXPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSXPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 52 - protein, 540 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAP

SEQ ID NO: 53 - protein, 576 aa, Artificial Sequence
  Description of Artificial Sequence: Synthetic polypeptide
GSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESS

SEQ ID NO: 54 - protein, 576 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 55 - protein, 576 aa, Artificial Sequence
  Description of Artificial Sequence: Synthetic polypeptide
GSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASP

SEQ ID NO: 56 - protein, 576 aa, Artificial Sequence
  Description of Artificial Sequence: Synthetic polypeptide
PGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGS

SEQ ID NO: 57 - protein, 625 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 58 - protein, 836 aa, Artificial Sequence
  Description of Artificial Sequence: Synthetic polypeptide
GSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSS

SEQ ID NO: 59 - protein, 864 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 60 - protein, 875 aa, Artificial Sequence
  Description of Artificial Sequence: Synthetic polypeptide
  MOD_RES (430)..(432): Any amino acid
  MOD_RES (443)..(446): Any amino acid
GSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSP

SEQ ID NO: 61 - protein, 864 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 62 - protein, 875 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 63 - protein, 913 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 64 - protein, 924 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 65 - protein, 1318 aa, Artificial Sequence
  Description of Artificial Sequence: Synthetic polypeptide
GTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAP

SEQ ID NO: 66 - protein, 864 aa, Artificial Sequence
  Description of Artificial Sequence: Synthetic polypeptide
GTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSA

SEQ ID NO: 67 - protein, 864 aa, Artificial Sequence
  Description of Artificial Sequence: Synthetic polypeptide
GSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETA

SEQ ID NO: 68 - protein, 948 aa, Artificial Sequence
  Description of Artificial Sequence: Synthetic polypeptide
GTSTEPSEGSAPGTSESATPESGPGSEPATSGSETPGTSESATPESGPGTSTEPSEGSAPGSPAGSPTSTEEGTSTEPSEGSAPGSEPATSGSETPGTSESATPESGPGTSESATPESGPGSEPATSGSETPGTSTEPSEGSAPGTSESATPESGPGTSTEPSEGSAPGTSTEPSEGSAPGSEPATSGSETPGTSTEPSEGSAPGSEPATSGSETPGSEPATSGSETPGTSTEPSEGSAPGSEPATSGSETPGSEPATSGSETPGTSTEPSEGSAPGSEPATSGSETPGSPAGSPTSTEEGTSESATPESGPGTSTEPSEGSAPGSEPATSGSETPGTSESATPESGPGSEPATSGSETPGSEPATSGSETPGTSESATPESGPGSPAGSPTSTEEGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSESATPESGPGSPAGSPTSTEEGSPAGSPTSTEEGTSESATPESGPGTSESATPESGPGTSTEPSEGSAPGSPAGSPTSTEEGTSESATPESGPGTSTEPSEGSAPGSEPATSGSETPGSPAGSPTSTEEGTSESATPESGPGTSTEPSEGSAPGSEPATSGSETPGSEPATSGSETPGSEPATSGSETPGSPAGSPTSTEEGTSESATPESGPGSEPATSGSETPGSEPATSGSETPGSPAGSPTSTEEGSPAGSPTSTEEGSPAGSPTSTEEGTSESATPESGPGSEPATSGSETPGTSTEPSEGSAPGTSTEPSEGSAPGSPAGSPTSTEEGSPAGSPTSTEEGSPAGSPTSTEEGTSTEPSEGSAPGTSESATPESGPGTSESATPESGPGTSTEPSEGSAPGTSTEPSEGSAPGTSTEPSEGSAPGTSESATPESGPGTSESATPESGP

SEQ ID NO: 69 - protein, 1024 aa, Artificial Sequence
  Description of Artificial Sequence: Synthetic polypeptide
GSEPATSGSETPGSEPATSGSETPGTSTEPSEGSAPGTSESATPESGPGSPAGSPTSTEEGTSTEPSEGSAPGTSESATPESGPGTSESATPESGPGSEPATSGSETPGSEPATSGSETPGTSESATPESGPGTSESATPESGPGSPAGSPTSTEEGTSTEPSEGSAPGSEPATSGSETPGTSTEPSEGSAPGSPAGSPTSTEEGSPAGSPTSTEEGSPAGSPTSTEEGTSTEPSEGSAPGTSESATPESGPGSEPATSGSETPGTSESATPESGPGTSESATPESGPGSPAGSPTSTEEGTSTEPSEGSAPGSEPATSGSETPGTSTEPSEGSAPGTSESATPESGPGSPAGSPTSTEEGTSTEPSEGSAPGTSTEPSEGSAPGSPAGSPTSTEEGTSTEPSEGSAPGTSESATPESGPGSPAGSPTSTEEGTSESATPESGPGSEPATSGSETPGTSTEPSEGSAPGSEPATSGSETPGTSESATPESGPGTSTEPSEGSAPGTSESATPESGPGTSTEPSEGSAPGTSTEPSEGSAPGSEPATSGSETPGSPAGSPTSTEEGTSESATPESGPGTSTEPSEGSAPGSPAGSPTSTEEGTSTEPSEGSAPGTSESATPESGPGTSTEPSEGSAPGSEPATSGSETPGSEPATSGSETPGTSESATPESGPGTSESATPESGPGTSESATPESGPGTSTEPSEGSAPGTSTEPSEGSAPGSPAGSPTSTEEGSPAGSPTSTEEGTSESATPESGPGSPAGSPTSTEEGSPAGSPTSTEEGTSESATPESGPGSEPATSGSETPGTSTEPSEGSAPGSEPATSGSETPGSPAGSPTSTEEGTSESATPESGPGTSESATPESGPGSEPATSGSETPGTSTEPSEGSAPGTSTEPSEGSAPGSPAGSPTSTEEGTSTEPSEGSAPGTSTEPSEGSAPGSEPATSGSETPGSPAGSPTSTEEGTSESATPESGPGTSTEPSEGSAPGSPAGSPTSTEEGTSESATPESGPGTSESATPESGPGTST

SEQ ID NO: 70 - protein, 1024 aa, Artificial Sequence
  Description of Artificial Sequence: Synthetic polypeptide
GSEPATSGSETPGSEPATSGSETPGTSTEPSEGSAPGSEPATSGSETPGTSESATPESGPGSEPATSGSETPGSPAGSPTSTEEGTSESATPESGPGSEPATSGSETPGTSTEPSEGSAPGTSESATPESGPGTSESATPESGPGTSTEPSEGSAPGTSTEPSEGSAPGSEPATSGSETPGSPAGSPTSTEEGTSTEPSEGSAPGSEPATSGSETPGSPAGSPTSTEEGTSTEPSEGSAPGTSESATPESGPGSPAGSPTSTEEGTSTEPSEGSAPGTSESATPESGPGSEPATSGSETPGTSESATPESGPGSEPATSGSETPGTSTEPSEGSAPGTSTEPSEGSAPGTSTEPSEGSAPGSPAGSPTSTEEGSPAGSPTSTEEGTSESATPESGPGTSTEPSEGSAPGTSTEPSEGSAPGSPAGSPTSTEEGSPAGSPTSTEEGSPAGSPTSTEEGTSESATPESGPGSEPATSGSETPGTSESATPESGPGSPAGSPTSTEEGTSTEPSEGSAPGTSESATPESGPGSEPATSGSETPGSPAGSPTSTEEGTSTEPSEGSAPGTSESATPESGPGTSESATPESGPGSPAGSPTSTEEGTSTEPSEGSAPGSPAGSPTSTEEGSPAGSPTSTEEGTSESATPESGPGSEPATSGSETPGTSTEPSEGSAPGSEPATSGSETPGTSESATPESGPGTSTEPSEGSAPGTSESATPESGPGTSESATPESGPGTSTEPSEGSAPGTSTEPSEGSAPGSEPATSGSETPGTSESATPESGPGTSTEPSEGSAPGSEPATSGSETPGSPAGSPTSTEEGTSESATPESGPGSPAGSPTSTEEGTSTEPSEGSAPGSEPATSGSETPGSEPATSGSETPGSEPATSGSETPGTSESATPESGPGTSESATPESGPGTSTEPSEGSAPGTSTEPSEGSAPGSEPATSGSETPGTSTEPSEGSAPGTSESATPESGPGSPAGSPTSTEEGSPAGSPTSTEEGTSTEPSEGSAPGSPAGSPTSTEEGSPA

SEQ ID NO: 71 - protein, 1024 aa, Artificial Sequence
  Description of Artificial Sequence: Synthetic polypeptide
GSPAGSPTSTEEGTSTEPSEGSAPGSPAGSPTSTEEGTSESATPESGPGSEPATSGSETPGTSTEPSEGSAPGTSTEPSEGSAPGTSESATPESGPGTSTEPSEGSAPGTSTEPSEGSAPGSEPATSGSETPGSPAGSPTSTEEGTSESATPESGPGSPAGSPTSTEEGTSTEPSEGSAPGSPAGSPTSTEEGTSTEPSEGSAPGSPAGSPTSTEEGTSTEPSEGSAPGSPAGSPTSTEEGSPAGSPTSTEEGTSTEPSEGSAPGSEPATSGSETPGSPAGSPTSTEEGTSESATPESGPGSEPATSGSETPGSEPATSGSETPGTSESATPESGPGSPAGSPTSTEEGTSESATPESGPGSEPATSGSETPGSEPATSGSETPGTSESATPESGPGTSESATPESGPGTSTEPSEGSAPGTSTEPSEGSAPGTSESATPESGPGSPAGSPTSTEEGTSTEPSEGSAPGSEPATSGSETPGSPAGSPTSTEEGTSTEPSEGSAPGTSTEPSEGSAPGSPAGSPTSTEEGSPAGSPTSTEEGSPAGSPTSTEEGTSESATPESGPGSEPATSGSETPGTSESATPESGPGTSESATPESGPGTSTEPSEGSAPGTSESATPESGPGSPAGSPTSTEEGTSESATPESGPGTSESATPESGPGTSTEPSEGSAPGSEPATSGSETPGTSTEPSEGSAPGSPAGSPTSTEEGTSESATPESGPGTSTEPSEGSAPGTSTEPSEGSAPGSEPATSGSETPGSEPATSGSETPGTSESATPESGPGSEPATSGSETPGSPAGSPTSTEEGTSESATPESGPGSEPATSGSETPGTSTEPSEGSAPGTSESATPESGPGTSESATPESGPGTSTEPSEGSAPGSEPATSGSETPGTSTEPSEGSAPGSPAGSPTSTEEGSPAGSPTSTEEGTSESATPESGPGSEPATSGSETPGSPAGSPTSTEEGSPAGSPTSTEEGTSESATPESGPGSEPATSGSETPGTSTEPSEGSAPGTSTEPSEGSAPGSEP

SEQ ID NO: 72 - protein, 1024 aa, Artificial Sequence
  Description of Artificial Sequence: Synthetic polypeptide
GSPAGSPTSTEEGTSTEPSEGSAPGTSESATPESGPGTSESATPESGPGSEPATSGSETPGTSTEPSEGSAPGTSESATPESGPGSPAGSPTSTEEGTSTEPSEGSAPGTSESATPESGPGSPAGSPTSTEEGTSTEPSEGSAPGTSESATPESGPGTSTEPSEGSAPGSEPATSGSETPGSEPATSGSETPGSEPATSGSETPGTSESATPESGPGSPAGSPTSTEEGTSESATPESGPGSEPATSGSETPGTSESATPESGPGTSESATPESGPGSPAGSPTSTEEGTSTEPSEGSAPGTSESATPESGPGTSTEPSEGSAPGTSTEPSEGSAPGTSTEPSEGSAPGSEPATSGSETPGTSTEPSEGSAPGTSESATPESGPGTSESATPESGPGTSTEPSEGSAPGTSESATPESGPGTSESATPESGPGSEPATSGSETPGTSTEPSEGSAPGTSESATPESGPGSPAGSPTSTEEGSPAGSPTSTEEGTSTEPSEGSAPGSEPATSGSETPGSEPATSGSETPGTSTEPSEGSAPGSEPATSGSETPGSPAGSPTSTEEGTSESATPESGPGSEPATSGSETPGSEPATSGSETPGTSESATPESGPGTSESATPESGPGTSTEPSEGSAPGSPAGSPTSTEEGTSESATPESGPGTSTEPSEGSAPGSEPATSGSETPGSPAGSPTSTEEGTSTEPSEGSAPGTSTEPSEGSAPGSEPATSGSETPGTSESATPESGPGTSTEPSEGSAPGSPAGSPTSTEEGTSESATPESGPGTSESATPESGPGTSTEPSEGSAPGSEPATSGSETPGSEPATSGSETPGTSTEPSEGSAPGTSESATPESGPGSPAGSPTSTEEGTSTEPSEGSAPGTSTEPSEGSAPGSPAGSPTSTEEGSPAGSPTSTEEGTSTEPSEGSAPGSEPATSGSETPGSPAGSPTSTEEGTSESATPESGPGSEPATSGSETPGSEPATSGSETPGTSESATPESGPGTSESATPESGPGTSTEPSEGSAPGTST

SEQ ID NO: 73 - protein, 1024 aa, Artificial Sequence
  Description of Artificial Sequence: Synthetic polypeptide
GSEPATSGSETPGSPAGSPTSTEEGTSTEPSEGSAPGSEPATSGSETPGTSESATPESGPGTSTEPSEGSAPGTSESATPESGPGSPAGSPTSTEEGTSTEPSEGSAPGTSTEPSEGSAPGSPAGSPTSTEEGTSTEPSEGSAPGTSESATPESGPGSEPATSGSETPGTSESATPESGPGSEPATSGSETPGTSTEPSEGSAPGTSTEPSEGSAPGSEPATSGSETPGTSTEPSEGSAPGTSTEPSEGSAPGSPAGSPTSTEEGTSTEPSEGSAPGTSESATPESGPGTSESATPESGPGTSTEPSEGSAPGTSTEPSEGSAPGSPAGSPTSTEEGSPAGSPTSTEEGTSTEPSEGSAPGSEPATSGSETPGSPAGSPTSTEEGTSTEPSEGSAPGSPAGSPTSTEEGSPAGSPTSTEEGTSESATPESGPGSEPATSGSETPGSEPATSGSETPGTSTEPSEGSAPGSPAGSPTSTEEGSPAGSPTSTEEGTSESATPESGPGSEPATSGSETPGSEPATSGSETPGTSESATPESGPGSEPATSGSETPGSEPATSGSETPGTSESATPESGPGTSESATPESGPGTSESATPESGPGTSESATPESGPGSPAGSPTSTEEGTSTEPSEGSAPGTSESATPESGPGTSTEPSEGSAPGTSTEPSEGSAPGTSESATPESGPGTSTEPSEGSAPGTSESATPESGPGSPAGSPTSTEEGTSTEPSEGSAPGSEPATSGSETPGTSTEPSEGSAPGSEPATSGSETPGTSTEPSEGSAPGTSTEPSEGSAPGSPAGSPTSTEEGTSESATPESGPGTSTEPSEGSAPGSEPATSGSETPGTSESATPESGPGTSESATPESGPGTSESATPESGPGTSTEPSEGSAPGSEPATSGSETPGSPAGSPTSTEEGTSESATPESGPGTSTEPSEGSAPGTSTEPSEGSAPGSPAGSPTSTEEGTSESATPESGPGTSTEPSEGSAPGTSTEPSEGSAPGSPAGSPTSTEEGTSESATPESGPGSPA

SEQ ID NO: 74 - protein, 1024 aa, Artificial Sequence
  Description of Artificial Sequence: Synthetic polypeptide
GTSTEPSEGSAPGTSTEPSEGSAPGTSTEPSEGSAPGTSTEPSEGSAPGSPAGSPTSTEEGSPAGSPTSTEEGTSESATPESGPGSEPATSGSETPGTSTEPSEGSAPGTSESATPESGPGTSTEPSEGSAPGTSESATPESGPGTSESATPESGPGSPAGSPTSTEEGTSTEPSEGSAPGSEPATSGSETPGTSTEPSEGSAPGSPAGSPTSTEEGTSTEPSEGSAPGSPAGSPTSTEEGSPAGSPTSTEEGSPAGSPTSTEEGTSESATPESGPGSEPATSGSETPGTSESATPESGPGTSESATPESGPGSPAGSPTSTEEGTSTEPSEGSAPGSEPATSGSETPGTSTEPSEGSAPGSPAGSPTSTEEGSPAGSPTSTEEGTSTEPSEGSAPGSEPATSGSETPGSPAGSPTSTEEGTSESATPESGPGSEPATSGSETPGSPAGSPTSTEEGTSESATPESGPGTSESATPESGPGTSTEPSEGSAPGSEPATSGSETPGSEPATSGSETPGTSESATPESGPGSEPATSGSETPGTSTEPSEGSAPGSPAGSPTSTEEGTSTEPSEGSAPGSEPATSGSETPGSEPATSGSETPGSPAGSPTSTEEGTSESATPESGPGTSTEPSEGSAPGSPAGSPTSTEEGSPAGSPTSTEEGTSESATPESGPGSPAGSPTSTEEGTSTEPSEGSAPGSEPATSGSETPGSEPATSGSETPGSEPATSGSETPGTSESATPESGPGTSESATPESGPGTSTEPSEGSAPGTSTEPSEGSAPGSEPATSGSETPGTSTEPSEGSAPGTSESATPESGPGSPAGSPTSTEEGSPAGSPTSTEEGTSTEPSEGSAPGTSESATPESGPGSPAGSPTSTEEGTSTEPSEGSAPGSEPATSGSETPGTSESATPESGPGSEPATSGSETPGTSESATPESGPGSEPATSGSETPGSEPATSGSETPGTSTEPSEGSAPGTSESATPESGPGTSTEPSEGSAPGTSTEPSEGSAPGTSESATPESGPGSPA

SEQ ID NO: 75 - protein, 1024 aa, Artificial Sequence
  Description of Artificial Sequence: Synthetic polypeptide
GSEPATSGSETPGTSTEPSEGSAPGSEPATSGSETPGTSTEPSEGSAPGTSESATPESGPGTSESATPESGPGSEPATSGSETPGTSTEPSEGSAPGTSTEPSEGSAPGTSESATPESGPGTSTEPSEGSAPGTSTEPSEGSAPGSEPATSGSETPGSPAGSPTSTEEGTSESATPESGPGTSESATPESGPGTSTEPSEGSAPGTSESATPESGPGSEPATSGSETPGTSESATPESGPGTSESATPESGPGTSTEPSEGSAPGTSTEPSEGSAPGSEPATSGSETPGSPAGSPTSTEEGTSESATPESGPGSEPATSGSETPGSEPATSGSETPGTSESATPESGPGTSESATPESGPGSPAGSPTSTEEGTSTEPSEGSAPGTSESATPESGPGTSTEPSEGSAPGTSTEPSEGSAPGTSESATPESGPGTSTEPSEGSAPGSPAGSPTSTEEGSPAGSPTSTEEGTSESATPESGPGSEPATSGSETPGSEPATSGSETPGTSTEPSEGSAPGTSESATPESGPGSPAGSPTSTEEGSPAGSPTSTEEGTSTEPSEGSAPGSPAGSPTSTEEGSPAGSPTSTEEGTSESATPESGPGSEPATSGSETPGTSTEPSEGSAPGTSTEPSEGSAPGSEPATSGSETPGSPAGSPTSTEEGTSESATPESGPGSPAGSPTSTEEGTSTEPSEGSAPGTSESATPESGPGSEPATSGSETPGTSESATPESGPGTSESATPESGPGSPAGSPTSTEEGTSTEPSEGSAPGSEPATSGSETPGSPAGSPTSTEEGTSTEPSEGSAPGSEPATSGSETPGSEPATSGSETPGTSESATPESGPGTSESATPESGPGTSTEPSEGSAPGTSESATPESGPGSEPATSGSETPGTSESATPESGPGTSESATPESGPGTSTEPSEGSAPGTSESATPESGPGSEPATSGSETPGTSTEPSEGSAPGSPAGSPTSTEEGTSESATPESGPGTSTEPSEGSAPGTSTEPSEGSAPGSPAGSPTSTEEGTST

SEQ ID NO: 76 - protein, 1024 aa, Artificial Sequence
  Description of Artificial Sequence: Synthetic polypeptide
GTSESATPESGPGTSTEPSEGSAPGTSESATPESGPGTSTEPSEGSAPGSEPATSGSETPGSPAGSPTSTEEGTSESATPESGPGSEPATSGSETPGSEPATSGSETPGTSESATPESGPGTSESATPESGPGTSTEPSEGSAPGSEPATSGSETPGSEPATSGSETPGTSESATPESGPGTSESATPESGPGSEPATSGSETPGTSESATPESGPGSPAGSPTSTEEGSPAGSPTSTEEGTSTEPSEGSAPGSEPATSGSETPGSPAGSPTSTEEGTSESATPESGPGSPAGSPTSTEEGTSTEPSEGSAPGSEPATSGSETPGSPAGSPTSTEEGTSESATPESGPGSPAGSPTSTEEGSPAGSPTSTEEGTSTEPSEGSAPGSEPATSGSETPGSPAGSPTSTEEGTSESATPESGPGTSTEPSEGSAPGSPAGSPTSTEEGTSESATPESGPGSEPATSGSETPGTSTEPSEGSAPGSPAGSPTSTEEGTSTEPSEGSAPGTSESATPESGPGTSESATPESGPGTSTEPSEGSAPGTSTEPSEGSAPGSEPATSGSETPGTSESATPESGPGTSESATPESGPGTSTEPSEGSAPGTSTEPSEGSAPGSPAGSPTSTEEGSPAGSPTSTEEGTSTEPSEGSAPGSEPATSGSETPGSEPATSGSETPGTSESATPESGPGSPAGSPTSTEEGTSESATPESGPGTSTEPSEGSAPGTSTEPSEGSAPGSPAGSPTSTEEGSPAGSPTSTEEGTSESATPESGPGSPAGSPTSTEEGTSTEPSEGSAPGSEPATSGSETPGSPAGSPTSTEEGSPAGSPTSTEEGTSTEPSEGSAPGTSESATPESGPGTSESATPESGPGSPAGSPTSTEEGTSTEPSEGSAPGSPAGSPTSTEEGTSTEPSEGSAPGSPAGSPTSTEEGTSTEPSEGSAPGTSTEPSEGSAPGSEPATSGSETPGSPAGSPTSTEEGTSESATPESGPGSEPATSGSETPGSPAGSPTSTEEGTSESATPESGPGTSE

SEQ ID NO: 77 - protein, 1024 aa, Artificial Sequence
  Description of Artificial Sequence: Synthetic polypeptide
GTSESATPESGPGSPAGSPTSTEEGSPAGSPTSTEEGTSESATPESGPGSEPATSGSETPGTSTEPSEGSAPGTSTEPSEGSAPGTSTEPSEGSAPGSPAGSPTSTEEGTSTEPSEGSAPGTSESATPESGPGTSESATPESGPGSPAGSPTSTEEGSPAGSPTSTEEGSPAGSPTSTEEGTSESATPESGPGSEPATSGSETPGTSESATPESGPGTSTEPSEGSAPGTSESATPESGPGTSTEPSEGSAPGTSTEPSEGSAPGTSESATPESGPGSPAGSPTSTEEGTSESATPESGPGTSTEPSEGSAPGSPAGSPTSTEEGTSESATPESGPGSEPATSGSETPGTSTEPSEGSAPGSEPATSGSETPGSEPATSGSETPGTSESATPESGPGTSESATPESGPGTSTEPSEGSAPGTSESATPESGPGSPAGSPTSTEEGTSTEPSEGSAPGSEPATSGSETPGTSESATPESGPGSEPATSGSETPGTSTEPSEGSAPGTSESATPESGPGSPAGSPTSTEEGSPAGSPTSTEEGSPAGSPTSTEEGTSESATPESGPGSEPATSGSETPGTSESATPESGPGTSESATPESGPGSEPATSGSETPGTSTEPSEGSAPGTSTEPSEGSAPGTSTEPSEGSAPGTSESATPESGPGSEPATSGSETPGTSESATPESGPGSEPATSGSETPGTSTEPSEGSAPGSEPATSGSETPGSPAGSPTSTEEGTSESATPESGPGTSESATPESGPGTSESATPESGPGSPAGSPTSTEEGTSTEPSEGSAPGTSESATPESGPGTSESATPESGPGTSTEPSEGSAPGTSTEPSEGSAPGSPAGSPTSTEEGTSESATPESGPGSEPATSGSETPGTSESATPESGPGTSESATPESGPGTSTEPSEGSAPGSEPATSGSETPGTSESATPESGPGSPAGSPTSTEEGTSTEPSEGSAPGSEPATSGSETPGSPAGSPTSTEEGTSESATPESGPGSPAGSPTSTEEGTSTEPSEGSAPGSEP

SEQ ID NO: 78 - protein, 1024 aa, Artificial Sequence
  Description of Artificial Sequence: Synthetic polypeptide
GSEPATSGSETPGTSTEPSEGSAPGTSESATPESGPGSEPATSGSETPGTSTEPSEGSAPGSPAGSPTSTEEGTSESATPESGPGSPAGSPTSTEEGTSTEPSEGSAPGSEPATSGSETPGTSTEPSEGSAPGTSESATPESGPGSEPATSGSETPGSEPATSGSETPGTSESATPESGPGTSTEPSEGSAPGTSESATPESGPGTSESATPESGPGSPAGSPTSTEEGSPAGSPTSTEEGTSESATPESGPGTSESATPESGPGTSTEPSEGSAPGTSTEPSEGSAPGSPAGSPTSTEEGTSTEPSEGSAPGSEPATSGSETPGSEPATSGSETPGSEPATSGSETPGSEPATSGSETPGTSESATPESGPGTSESATPESGPGTSESATPESGPGTSTEPSEGSAPGTSESATPESGPGTSESATPESGPGTSTEPSEGSAPGSPAGSPTSTEEGTSTEPSEGSAPGSEPATSGSETPGSPAGSPTSTEEGTSESATPESGPGTSTEPSEGSAPGSEPATSGSETPGTSESATPESGPGTSESATPESGPGTSTEPSEGSAPGSEPATSGSETPGSPAGSPTSTEEGTSESATPESGPGTSESATPESGPGTSTEPSEGSAPGSEPATSGSETPGSPAGSPTSTEEGTSESATPESGPGSEPATSGSETPGTSTEPSEGSAPGSEPATSGSETPGSPAGSPTSTEEGTSESATPESGPGTSTEPSEGSAPGSEPATSGSETPGTSESATPESGPGTSESATPESGPGSPAGSPTSTEEGTSTEPSEGSAPGSPAGSPTSTEEGSPAGSPTSTEEGSPAGSPTSTEEGTSESATPESGPGSEPATSGSETPGTSTEPSEGSAPGTSTEPSEGSAPGTSESATPESGPGTSTEPSEGSAPGTSESATPESGPGSEPATSGSETPGTSTEPSEGSAPGTSESATPESGPGSPAGSPTSTEEGSPAGSPTSTEEGSPAGSPTSTEEGTSESATPESGPGSPAGSPTSTEEGTSESATPESGPGSEP

SEQ ID NO: 79 - protein, 1024 aa, Artificial Sequence
  Description of Artificial Sequence: Synthetic polypeptide
GTSTEPSEGSAPGSEPATSGSETPGTSTEPSEGSAPGTSTEPSEGSAPGSEPATSGSETPGSPAGSPTSTEEGSPAGSPTSTEEGTSESATPESGPGSEPATSGSETPGTSTEPSEGSAPGTSTEPSEGSAPGSPAGSPTSTEEGTSESATPESGPGTSESATPESGPGSPAGSPTSTEEGTSTEPSEGSAPGTSESATPESGPGTSTEPSEGSAPGSEPATSGSETPGTSESATPESGPGSEPATSGSETPGTSTEPSEGSAPGTSTEPSEGSAPGSPAGSPTSTEEGSPAGSPTSTEEGTSESATPESGPGSPAGSPTSTEEGTSTEPSEGSAPGSEPATSGSETPGSEPATSGSETPGSPAGSPTSTEEGTSESATPESGPGTSTEPSEGSAPGSEPATSGSETPGTSESATPESGPGSEPATSGSETPGSPAGSPTSTEEGTSESATPESGPGTSESATPESGPGSEPATSGSETPGTSESATPESGPGTSESATPESGPGTSESATPESGPGTSTEPSEGSAPGTSESATPESGPGSEPATSGSETPGTSTEPSEGSAPGSPAGSPTSTEEGTSTEPSEGSAPGSEPATSGSETPGSPAGSPTSTEEGTSESATPESGPGTSESATPESGPGTSTEPSEGSAPGTSESATPESGPGTSTEPSEGSAPGTSESATPESGPGSEPATSGSETPGTSTEPSEGSAPGTSTEPSEGSAPGSPAGSPTSTEEGSPAGSPTSTEEGTSESATPESGPGTSTEPSEGSAPGTSESATPESGPGSPAGSPTSTEEGSPAGSPTSTEEGSPAGSPTSTEEGTSTEPSEGSAPGSPAGSPTSTEEGSPAGSPTSTEEGTSESATPESGPGSEPATSGSETPGSEPATSGSETPGTSESATPESGPGSEPATSGSETPGTSESATPESGPGTSTEPSEGSAPGTSTEPSEGSAPGSPAGSPTSTEEGSPAGSPTSTEEGTSESATPESGPGSPAGSPTSTEEGTSTEPSEGSAPGTSESATPESGPGTSE

SEQ ID NO: 80 - protein, 948 aa, Artificial Sequence
  Description of Artificial Sequence: Synthetic polypeptide
GSSTPSGATGSPGTPGSGTASSSPGASPGTSSTGSPGSSPSASTGTGPGTPGSGTASSSPGTPGSGTASSSPGTPGSGTASSSPGSSPSASTGTGPGTPGSGTASSSPGSSPSASTGTGPGSSTPSGATGSPGSSTPSGATGSPGSSPSASTGTGPGSSTPSGATGSPGASPGTSSTGSPGASPGTSSTGSPGSSPSASTGTGPGSSPSASTGTGPGASPGTSSTGSPGSSPSASTGTGPGASPGTSSTGSPGSSPSASTGTGPGASPGTSSTGSPGTPGSGTASSSPGTPGSGTASSSPGSSTPSGATGSPGSSTPSGATGSPGSSTPSGATGSPGASPGTSSTGSPGSSPSASTGTGPGASPGTSSTGSPGASPGTSSTGSPGSSTPSGATGSPGSSPSASTGTGPGSSPSASTGTGPGTPGSGTASSSPGASPGTSSTGSPGTPGSGTASSSPGSSTPSGATGSPGSSTPSGATGSPGSSPSASTGTGPGSSPSASTGTGPGSSTPSGATGSPGASPGTSSTGSPGTPGSGTASSSPGSSPSASTGTGPGSSTPSGATGSPGASPGTSSTGSPGSSTPSGATGSPGTPGSGTASSSPGSSPSASTGTGPGSSTPSGATGSPGASPGTSSTGSPGASPGTSSTGSPGTPGSGTASSSPGTPGSGTASSSPGSSPSASTGTGPGASPGTSSTGSPGASPGTSSTGSPGTPGSGTASSSPGTPGSGTASSSPGSSTPSGATGSPGSSPSASTGTGPGSSTPSGATGSPGSSPSASTGTGPGSSPSASTGTGPGTPGSGTASSSPGSSTPSGATGSPGASPGTSSTGSPGTPGSGTASSSPGTPGSGTASSSPGSSTPSGATGSPGTPGSGTASSSPGASPGTSSTGSPGSSTPSGATGSPGSSTPSGATGSPGTPGSGTASSSPGSSTPSGATGSPGSSTPSGATGSP

SEQ ID NO: 81 - protein, 1024 aa, Artificial Sequence
  Description of Artificial Sequence: Synthetic polypeptide
GTPGSGTASSSPGTPGSGTASSSPGSSPSASTGTGPGTPGSGTASSSPGASPGTSSTGSPGTPGSGTASSSPGSSPSASTGTGPGSSTPSGATGSPGASPGTSSTGSPGASPGTSSTGSPGSSPSASTGTGPGSSTPSGATGSPGSSPSASTGTGPGSSPSASTGTGPGTPGSGTASSSPGTPGSGTASSSPGASPGTSSTGSPGSSTPSGATGSPGSSPSASTGTGPGTPGSGTASSSPGASPGTSSTGSPGTPGSGTASSSPGSSPSASTGTGPGSSPSASTGTGPGASPGTSSTGSPGASPGTSSTGSPGSSTPSGATGSPGSSTPSGATGSPGTPGSGTASSSPGSSPSASTGTGPGSSTPSGATGSPGASPGTSSTGSPGSSTPSGATGSPGSSTPSGATGSPGSSPSASTGTGPGASPGTSSTGSPGTPGSGTASSSPGASPGTSSTGSPGSSPSASTGTGPGTPGSGTASSSPGASPGTSSTGSPGASPGTSSTGSPGSSTPSGATGSPGTPGSGTASSSPGSSTPSGATGSPGASPGTSSTGSPGTPGSGTASSSPGTPGSGTASSSPGSSTPSGATGSPGSSTPSGATGSPGTPGSGTASSSPGSSTPSGATGSPGSSTPSGATGSPGASPGTSSTGSPGSSPSASTGTGPGSSPSASTGTGPGASPGTSSTGSPGASPGTSSTGSPGTPGSGTASSSPGSSPSASTGTGPGTPGSGTASSSPGSSTPSGATGSPGSSTPSGATGSPGASPGTSSTGSPGSSPSASTGTGPGASPGTSSTGSPGSSPSASTGTGPGSSPSASTGTGPGASPGTSSTGSPGASPGTSSTGSPGSSTPSGATGSPGASPGTSSTGSPGASPGTSSTGSPGTPGSGTASSSPGTPGSGTASSSPGTPGSGTASSSPGSSTPSGATGSPGSSTPSGATGSPGSSPSASTGTGPGSSPSASTGTGPGTPGSGTASSSPGSSPSASTGTGPGASPGTSSTGSPGSSTPSGATGSPGTPGSGTASSSPGSST

SEQ ID NO: 82 - protein, 1024 aa, Artificial Sequence
  Description of Artificial Sequence: Synthetic polypeptide
GASPGTSSTGSPGSSPSASTGTGPGSSTPSGATGSPGASPGTSSTGSPGASPGTSSTGSPGSSTPSGATGSPGTPGSGTASSSPGASPGTSSTGSPGTPGSGTASSSPGTPGSGTASSSPGSSTPSGATGSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGASPGTSSTGSPGSSTPSGATGSPGTPGSGTASSSPGSSPSASTGTGPGSSTPSGATGSPGSSPSASTGTGPGSSTPSGATGSPGASPGTSSTGSPGSSPSASTGTGPGTPGSGTASSSPGASPGTSSTGSPGSSTPSGATGSPGASPGTSSTGSPGSSPSASTGTGPGTPGSGTASSSPGTPGSGTASSSPGASPGTSSTGSPGTPGSGTASSSPGTPGSGTASSSPGSSPSASTGTGPGASPGTSSTGSPGSSTPSGATGSPGASPGTSSTGSPGSSPSASTGTGPGTPGSGTASSSPGSSPSASTGTGPGSSPSASTGTGPGASPGTSSTGSPGASPGTSSTGSPGTPGSGTASSSPGASPGTSSTGSPGASPGTSSTGSPGTPGSGTASSSPGTPGSGTASSSPGSSTPSGATGSPGSSTPSGATGSPGTPGSGTASSSPGSSPSASTGTGPGTPGSGTASSSPGSSTPSGATGSPGSSTPSGATGSPGASPGTSSTGSPGTPGSGTASSSPGASPGTSSTGSPGSSTPSGATGSPGSSTPSGATGSPGTPGSGTASSSPGSSTPSGATGSPGSSTPSGATGSPGASPGTSSTGSPGSSPSASTGTGPGSSTPSGATGSPGSSTPSGATGSPGSSPSASTGTGPGSSPSASTGTGPGSSTPSGATGSPGASPGTSSTGSPGSSPSASTGTGPGTPGSGTASSSPGASPGTSSTGSPGSSPSASTGTGPGASPGTSSTGSPGSSTPSGATGSPGSSPSASTGTGPGSSPSASTGTGPGASPGTSSTGSPGSST

SEQ ID NO: 83 - protein, 1024 aa, Artificial Sequence
  Description of Artificial Sequence: Synthetic polypeptide
GSSPSASTGTGPGTPGSGTASSSPGSSPSASTGTGPGSSPSASTGTGPGTPGSGTASSSPGASPGTSSTGSPGSSTPSGATGSPGTPGSGTASSSPGASPGTSSTGSPGTPGSGTASSSPGTPGSGTASSSPGSSPSASTGTGPGSSPSASTGTGPGSSTPSGATGSPGASPGTSSTGSPGSSPSASTGTGPGTPGSGTASSSPGTPGSGTASSSPGSSTPSGATGSPGASPGTSSTGSPGSSPSASTGTGPGTPGSGTASSSPGTPGSGTASSSPGASPGTSSTGSPGSSTPSGATGSPGSSTPSGATGSPGSSPSASTGTGPGSSPSASTGTGPGASPGTSSTGSPGSSPSASTGTGPGSSTPSGATGSPGASPGTSSTGSPGASPGTSSTGSPGSSTPSGATGSPGSSPSASTGTGPGASPGTSSTGSPGASPGTSSTGSPGTPGSGTASSSPGSSTPSGATGSPGASPGTSSTGSPGSSTPSGATGSPGTPGSGTASSSPGSSPSASTGTGPGSSTPSGATGSPGTPGSGTASSSPGSSTPSGATGSPGSSTPSGATGSPGASPGTSSTGSPGSSPSASTGTGPGSSPSASTGTGPGASPGTSSTGSPGSSPSASTGTGPGTPGSGTASSSPGTPGSGTASSSPGASPGTSSTGSPGTPGSGTASSSPGASPGTSSTGSPGTPGSGTASSSPGASPGTSSTGSPGSSTPSGATGSPGASPGTSSTGSPGSSPSASTGTGPGTPGSGTASSSPGTPGSGTASSSPGSSPSASTGTGPGTPGSGTASSSPGASPGTSSTGSPGSSTPSGATGSPGTPGSGTASSSPGASPGTSSTGSPGTPGSGTASSSPGTPGSGTASSSPGSSTPSGATGSPGTPGSGTASSSPGSSPSASTGTGPGSSTPSGATGSPGTPGSGTASSSPGSSTPSGATGSPGSSTPSGATGSPGSSPSASTGTGPGASPGTSSTGSPGTPGSGTASSSPGSSPSASTGTGPGSSPSASTGTGPGASPGTSSTGSPGASP

SEQ ID NO: 84 - protein, 1024 aa, Artificial Sequence
  Description of Artificial Sequence: Synthetic polypeptide
GSSTPSGATGSPGSSPSASTGTGPGTPGSGTASSSPGSSPSASTGTGPGASPGTSSTGSPGSSPSASTGTGPGTPGSGTASSSPGASPGTSSTGSPGSSTPSGATGSPGSSPSASTGTGPGSSTPSGATGSPGASPGTSSTGSPGTPGSGTASSSPGASPGTSSTGSPGSSTPSGATGSPGSSTPSGATGSPGSSPSASTGTGPGTPGSGTASSSPGSSTPSGATGSPGSSTPSGATGSPGSSPSASTGTGPGTPGSGTASSSPGASPGTSSTGSPGTPGSGTASSSPGASPGTSSTGSPGASPGTSSTGSPGTPGSGTASSSPGTPGSGTASSSPGSSTPSGATGSPGSSTPSGATGSPGSSTPSGATGSPGASPGTSSTGSPGSSPSASTGTGPGSSTPSGATGSPGSSPSASTGTGPGSSTPSGATGSPGTPGSGTASSSPGSSPSASTGTGPGSSTPSGATGSPGASPGTSSTGSPGASPGTSSTGSPGSSPSASTGTGPGASPGTSSTGSPGSSTPSGATGSPGASPGTSSTGSPGTPGSGTASSSPGTPGSGTASSSPGSSPSASTGTGPGTPGSGTASSSPGSSTPSGATGSPGSSPSASTGTGPGSSTPSGATGSPGTPGSGTASSSPGTPGSGTASSSPGSSPSASTGTGPGSSTPSGATGSPGSSTPSGATGSPGSSPSASTGTGPGSSPSASTGTGPGASPGTSSTGSPGASPGTSSTGSPGSSTPSGATGSPGASPGTSSTGSPGSSPSASTGTGPGTPGSGTASSSPGASPGTSSTGSPGASPGTSSTGSPGTPGSGTASSSPGTPGSGTASSSPGSSPSASTGTGPGTPGSGTASSSPGASPGTSSTGSPGSSTPSGATGSPGTPGSGTASSSPGTPGSGTASSSPGSSTPSGATGSPGSSTPSGATGSPGTPGSGTASSSPGSSPSASTGTGPGSSPSASTGTGPGASPGTSSTGSPGSSPSASTGTGPGSSPSASTGTGPGASPGTSSTGSPGASPGTSSTGSPGTPG

SEQ ID NO: 85 - protein, 1024 aa, Artificial Sequence
  Description of Artificial Sequence: Synthetic polypeptide
GTPGSGTASSSPGSSTPSGATGSPGASPGTSSTGSPGSSTPSGATGSPGTPGSGTASSSPGTPGSGTASSSPGSSTPSGATGSPGSSTPSGATGSPGASPGTSSTGSPGSSPSASTGTGPGSSTPSGATGSPGASPGTSSTGSPGSSPSASTGTGPGTPGSGTASSSPGASPGTSSTGSPGASPGTSSTGSPGTPGSGTASSSPGTPGSGTASSSPGASPGTSSTGSPGASPGTSSTGSPGTPGSGTASSSPGTPGSGTASSSPGSSPSASTGTGPGSSPSASTGTGPGASPGTSSTGSPGSSPSASTGTGPGSSPSASTGTGPGASPGTSSTGSPGASPGTSSTGSPGTPGSGTASSSPGTPGSGTASSSPGSSPSASTGTGPGASPGTSSTGSPGSSTPSGATGSPGASPGTSSTGSPGSSPSASTGTGPGSSTPSGATGSPGSSPSASTGTGPGSSPSASTGTGPGASPGTSSTGSPGSSPSASTGTGPGSSPSASTGTGPGASPGTSSTGSPGASPGTSSTGSPGSSPSASTGTGPGTPGSGTASSSPGASPGTSSTGSPGSSTPSGATGSPGTPGSGTASSSPGTPGSGTASSSPGSSPSASTGTGPGSSTPSGATGSPGASPGTSSTGSPGASPGTSSTGSPGSSTPSGATGSPGSSPSASTGTGPGASPGTSSTGSPGSSTPSGATGSPGTPGSGTASSSPGASPGTSSTGSPGTPGSGTASSSPGASPGTSSTGSPGSSTPSGATGSPGSSTPSGATGSPGASPGTSSTGSPGSSPSASTGTGPGTPGSGTASSSPGTPGSGTASSSPGSSTPSGATGSPGTPGSGTASSSPGASPGTSSTGSPGSSTPSGATGSPGTPGSGTASSSPGSSPSASTGTGPGSSTPSGATGSPGSSTPSGATGSPGSSPSASTGTGPGSSTPSGATGSPGTPGSGTASSSPGSSPSASTGTGPGTPGSGTASSSPGSSTPSGATGSPGSSPSASTGTGPGSSPSASTGTGPGTPGSGTASSSPGASP

SEQ ID NO: 86 - protein, 1024 aa, Artificial Sequence
  Description of Artificial Sequence: Synthetic polypeptide
GSSTPSGATGSPGTPGSGTASSSPGTPGSGTASSSPGASPGTSSTGSPGSSTPSGATGSPGTPGSGTASSSPGSSTPSGATGSPGSSPSASTGTGPGSSTPSGATGSPGTPGSGTASSSPGTPGSGTASSSPGSSPSASTGTGPGSSTPSGATGSPGSSPSASTGTGPGTPGSGTASSSPGASPGTSSTGSPGSSTPSGATGSPGASPGTSSTGSPGTPGSGTASSSPGSSTPSGATGSPGTPGSGTASSSPGSSPSASTGTGPGASPGTSSTGSPGASPGTSSTGSPGTPGSGTASSSPGSSTPSGATGSPGSSTPSGATGSPGSSPSASTGTGPGSSPSASTGTGPGASPGTSSTGSPGTPGSGTASSSPGTPGSGTASSSPGSSPSASTGTGPGASPGTSSTGSPGASPGTSSTGSPGTPGSGTASSSPGSSPSASTGTGPGASPGTSSTGSPGASPGTSSTGSPGSSTPSGATGSPGSSPSASTGTGPGSSPSASTGTGPGTPGSGTASSSPGTPGSGTASSSPGASPGTSSTGSPGSSTPSGATGSPGTPGSGTASSSPGASPGTSSTGSPGTPGSGTASSSPGTPGSGTASSSPGSSTPSGATGSPGSSTPSGATGSPGTPGSGTASSSPGSSPSASTGTGPGSSTPSGATGSPGSSTPSGATGSPGSSPSASTGTGPGTPGSGTASSSPGSSPSASTGTGPGASPGTSSTGSPGSSPSASTGTGPGTPGSGTASSSPGASPGTSSTGSPGASPGTSSTGSPGTPGSGTASSSPGTPGSGTASSSPGSSTPSGATGSPGTPGSGTASSSPGASPGTSSTGSPGSSTPSGATGSPGSSTPSGATGSPGSSTPSGATGSPGTPGSGTASSSPGSSPSASTGTGPGSSPSASTGTGPGSSPSASTGTGPGASPGTSSTGSPGASPGTSSTGSPGSSPSASTGTGPGTPGSGTASSSPGASPGTSSTGSPGSSTPSGATGSPGASPGTSSTGSPGASPGTSSTGSPGSSTPSGATGSPGTPG

SEQ ID NO: 87 - protein, 1024 aa, Artificial Sequence
  Description of Artificial Sequence: Synthetic polypeptide
GSSTPSGATGSPGSSTPSGATGSPGTPGSGTASSSPGSSPSASTGTGPGTPGSGTASSSPGASPGTSSTGSPGSSTPSGATGSPGASPGTSSTGSPGTPGSGTASSSPGASPGTSSTGSPGSSPSASTGTGPGTPGSGTASSSPGASPGTSSTGSPGSSTPSGATGSPGSSPSASTGTGPGSSTPSGATGSPGASPGTSSTGSPGASPGTSSTGSPGASPGTSSTGSPGSSTPSGATGSPGASPGTSSTGSPGTPGSGTASSSPGSSTPSGATGSPGSSTPSGATGSPGSSPSASTGTGPGSSPSASTGTGPGSSTPSGATGSPGSSPSASTGTGPGSSPSASTGTGPGASPGTSSTGSPGASPGTSSTGSPGTPGSGTASSSPGSSPSASTGTGPGSSPSASTGTGPGASPGTSSTGSPGSSPSASTGTGPGTPGSGTASSSPGSSPSASTGTGPGSSTPSGATGSPGASPGTSSTGSPGSSTPSGATGSPGTPGSGTASSSPGSSPSASTGTGPGASPGTSSTGSPGSSTPSGATGSPGASPGTSSTGSPGASPGTSSTGSPGTPGSGTASSSPGASPGTSSTGSPGASPGTSSTGSPGSSTPSGATGSPGTPGSGTASSSPGSSPSASTGTGPGSSTPSGATGSPGTPGSGTASSSPGSSTPSGATGSPGSSTPSGATGSPGSSPSASTGTGPGSSPSASTGTGPGSSTPSGATGSPGASPGTSSTGSPGSSPSASTGTGPGTPGSGTASSSPGASPGTSSTGSPGSSPSASTGTGPGSSTPSGATGSPGSSPSASTGTGPGSSTPSGATGSPGSSPSASTGTGPGTPGSGTASSSPGTPGSGTASSSPGSSTPSGATGSPGSSTPSGATGSPGTPGSGTASSSPGSSPSASTGTGPGSSTPSGATGSPGSSPSASTGTGPGSSPSASTGTGPGSSTPSGATGSPGASPGTSSTGSPGASPGTSSTGSPGTPGSGTASSSPGTPGSGTASSSPGTPGSGTASSSPGSSTPSGATGSPGSST

SEQ ID NO: 88 - protein, 1024 aa, Artificial Sequence
  Description of Artificial Sequence: Synthetic polypeptide
GASPGTSSTGSPGSSPSASTGTGPGSSTPSGATGSPGSSPSASTGTGPGTPGSGTASSSPGSSTPSGATGSPGSSTPSGATGSPGSSPSASTGTGPGSSTPSGATGSPGTPGSGTASSSPGSSPSASTGTGPGSSTPSGATGSPGASPGTSSTGSPGSSPSASTGTGPGSSPSASTGTGPGTPGSGTASSSPGASPGTSSTGSPGSSTPSGATGSPGSSPSASTGTGPGASPGTSSTGSPGSSTPSGATGSPGTPGSGTASSSPGSSPSASTGTGPGSSPSASTGTGPGSSPSASTGTGPGTPGSGTASSSPGTPGSGTASSSPGSSTPSGATGSPGTPGSGTASSSPGSSPSASTGTGPGASPGTSSTGSPGASPGTSSTGSPGTPGSGTASSSPGSSPSASTGTGPGASPGTSSTGSPGTPGSGTASSSPGSSTPSGATGSPGSSTPSGATGSPGASPGTSSTGSPGTPGSGTASSSPGSSPSASTGTGPGTPGSGTASSSPGASPGTSSTGSPGSSTPSGATGSPGASPGTSSTGSPGASPGTSSTGSPGTPGSGTASSSPGTPGSGTASSSPGSSPSASTGTGPGSSPSASTGTGPGSSPSASTGTGPGTPGSGTASSSPGASPGTSSTGSPGSSTPSGATGSPGASPGTSSTGSPGSSPSASTGTGPGASPGTSSTGSPGSSPSASTGTGPGASPGTSSTGSPGSSPSASTGTGPGSSPSASTGTGPGTPGSGTASSSPGASPGTSSTGSPGTPGSGTASSSPGTPGSGTASSSPGASPGTSSTGSPGSSTPSGATGSPGSSTPSGATGSPGSSPSASTGTGPGSSTPSGATGSPGTPGSGTASSSPGSSPSASTGTGPGSSTPSGATGSPGSSTPSGATGSPGSSPSASTGTGPGSSPSASTGTGPGASPGTSSTGSPGTPGSGTASSSPGSSPSASTGTGPGSSTPSGATGSPGASPGTSSTGSPGASPGTSSTGSPGSSPSASTGTGPGASPGTSSTGSPGASPGTSSTGSPGTPG

SEQ ID NO: 89 - protein, 1024 aa, Artificial Sequence
  Description of Artificial Sequence: Synthetic polypeptide
GSSTPSGATGSPGSSPSASTGTGPGASPGTSSTGSPGASPGTSSTGSPGTPGSGTASSSPGSSPSASTGTGPGASPGTSSTGSPGSSTPSGATGSPGSSTPSGATGSPGASPGTSSTGSPGSSPSASTGTGPGTPGSGTASSSPGTPGSGTASSSPGASPGTSSTGSPGSSTPSGATGSPGSSTPSGATGSPGSSPSASTGTGPGTPGSGTASSSPGASPGTSSTGSPGSSTPSGATGSPGTPGSGTASSSPGSSPSASTGTGPGSSTPSGATGSPGTPGSGTASSSPGSSPSASTGTGPGTPGSGTASSSPGASPGTSSTGSPGSSTPSGATGSPGSSTPSGATGSPGTPGSGTASSSPGSSTPSGATGSPGSSTPSGATGSPGASPGTSSTGSPGASPGTSSTGSPGASPGTSSTGSPGSSTPSGATGSPGTPGSGTASSSPGSSPSASTGTGPGTPGSGTASSSPGASPGTSSTGSPGTPGSGTASSSPGASPGTSSTGSPGSSTPSGATGSPGSSPSASTGTGPGSSPSASTGTGPGTPGSGTASSSPGASPGTSSTGSPGASPGTSSTGSPGTPGSGTASSSPGASPGTSSTGSPGSSTPSGATGSPGSSTPSGATGSPGSSPSASTGTGPGASPGTSSTGSPGASPGTSSTGSPGTPGSGTASSSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSTPSGATGSPGTPGSGTASSSPGSSPSASTGTGPGASPGTSSTGSPGSSTPSGATGSPGTPGSGTASSSPGSSTPSGATGSPGSSTPSGATGSPGSSTPSGATGSPGSSPSASTGTGPGSSPSASTGTGPGSSTPSGATGSPGSSPSASTGTGPGSSPSASTGTGPGSSTPSGATGSPGASPGTSSTGSPGASPGTSSTGSPGTPGSGTASSSPGASPGTSSTGSPGSSTPSGATGSPGASP

SEQ ID NO: 90 - protein, 1024 aa, Artificial Sequence
  Description of Artificial Sequence: Synthetic polypeptide
GSSPSASTGTGPGSSPSASTGTGPGSSPSASTGTGPGTPGSGTASSSPGSSPSASTGTGPGSSPSASTGTGPGASPGTSSTGSPGSSPSASTGTGPGTPGSGTASSSPGTPGSGTASSSPGASPGTSSTGSPGTPGSGTASSSPGTPGSGTASSSPGSSPSASTGTGPGSSTPSGATGSPGSSPSASTGTGPGASPGTSSTGSPGSSPSASTGTGPGASPGTSSTGSPGASPGTSSTGSPGTPGSGTASSSPGTPGSGTASSSPGASPGTSSTGSPGTPGSGTASSSPGTPGSGTASSSPGSSPSASTGTGPGSSTPSGATGSPGASPGTSSTGSPGSSTPSGATGSPGSSPSASTGTGPGSSPSASTGTGPGSSTPSGATGSPGASPGTSSTGSPGSSPSASTGTGPGTPGSGTASSSPGASPGTSSTGSPGASPGTSSTGSPGTPGSGTASSSPGTPGSGTASSSPGSSTPSGATGSPGTPGSGTASSSPGASPGTSSTGSPGSSTPSGATGSPGTPGSGTASSSPGSSPSASTGTGPGSSPSASTGTGPGSSTPSGATGSPGASPGTSSTGSPGASPGTSSTGSPGTPGSGTASSSPGTPGSGTASSSPGSSTPSGATGSPGSSPSASTGTGPGSSPSASTGTGPGASPGTSSTGSPGASPGTSSTGSPGSSTPSGATGSPGASPGTSSTGSPGASPGTSSTGSPGTPGSGTASSSPGTPGSGTASSSPGTPGSGTASSSPGSSTPSGATGSPGSSTPSGATGSPGSSPSASTGTGPGSSPSASTGTGPGSSTPSGATGSPGTPGSGTASSSPGSSPSASTGTGPGASPGTSSTGSPGSSTPSGATGSPGSSPSASTGTGPGSSTPSGATGSPGASPGTSSTGSPGSSPSASTGTGPGTPGSGTASSSPGSSPSASTGTGPGSSTPSGATGSPGASPGTSSTGSPGSSPSASTGTGPGTPGSGTASSSPGSSTPSGATGSPGSSTPSGATGSPGASPGTSSTGSPGSSPSASTGTGPGSSP

SEQ ID NO: 91 - protein, 1024 aa, Artificial Sequence
  Description of Artificial Sequence: Synthetic polypeptide
GSSPSASTGTGPGTPGSGTASSSPGSSTPSGATGSPGTPGSGTASSSPGSSTPSGATGSPGSSTPSGATGSPGSSPSASTGTGPGSSPSASTGTGPGSSPSASTGTGPGTPGSGTASSSPGASPGTSSTGSPGSSTPSGATGSPGTPGSGTASSSPGTPGSGTASSSPGSSTPSGATGSPGSSTPSGATGSPGSSPSASTGTGPGASPGTSSTGSPGASPGTSSTGSPGASPGTSSTGSPGASPGTSSTGSPGTPGSGTASSSPGTPGSGTASSSPGSSPSASTGTGPGSSTPSGATGSPGASPGTSSTGSPGSSTPSGATGSPGSSTPSGATGSPGSSPSASTGTGPGASPGTSSTGSPGTPGSGTASSSPGSSPSASTGTGPGSSPSASTGTGPGASPGTSSTGSPGASPGTSSTGSPGTPGSGTASSSPGASPGTSSTGSPGTPGSGTASSSPGTPGSGTASSSPGSSTPSGATGSPGTPGSGTASSSPGASPGTSSTGSPGSSTPSGATGSPGSSTPSGATGSPGSSPSASTGTGPGSSTPSGATGSPGSSTPSGATGSPGASPGTSSTGSPGSSPSASTGTGPGTPGSGTASSSPGASPGTSSTGSPGSSPSASTGTGPGTPGSGTASSSPGSSPSASTGTGPGTPGSGTASSSPGASPGTSSTGSPGASPGTSSTGSPGTPGSGTASSSPGTPGSGTASSSPGSSTPSGATGSPGSSTPSGATGSPGTPGSGTASSSPGSSTPSGATGSPGSSTPSGATGSPGASPGTSSTGSPGSSPSASTGTGPGSSTPSGATGSPGSSPSASTGTGPGSSPSASTGTGPGASPGTSSTGSPGSSTPSGATGSPGASPGTSSTGSPGTPGSGTASSSPGTPGSGTASSSPGSSPSASTGTGPGASPGTSSTGSPGSSTPSGATGSPGSSPSASTGTGPGSSPSASTGTGPGASPGTSSTGSPGTPGSGTASSSPGSSTPSGATGSPGTPGSGTASSSPGSSPSASTGTGPGSSPSASTGTGPGASP

SEQ ID NO: 92 - protein, 72 aa, Artificial Sequence
  Description of Artificial Sequence: Synthetic polypeptide
SPAGSPTSTEEGSPAGSPTSTEEGTSESATPESGPGTSTEPSEGSAPGTSESATPESGPGSEPATSGSETPG

SEQ ID NO: 93 - protein, 72 aa, Artificial Sequence
  Description of Artificial Sequence: Synthetic polypeptide
TSESATPESGPGTSESATPESGPGSEPATSGSETPGSEPATSGSETPGSPAGSPTSTEEGTSTEPSEGSAPG

SEQ ID NO: 94 - protein, 108 aa, Artificial Sequence
  Description of Artificial Sequence: Synthetic polypeptide
TEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTS

SEQ ID NO: 95 - protein, 108 aa, Artificial Sequence
  Description of Artificial Sequence: Synthetic polypeptide
GSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAP

SEQ ID NO: 96 - protein, 144 aa, Artificial Sequence
  Description of Artificial Sequence: Synthetic polypeptide
STEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGS

SEQ ID NO: 97 - protein, 144 aa, Artificial Sequence
  Description of Artificial Sequence: Synthetic polypeptide
SEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPG

SEQ ID NO: 98 - protein, 180 aa, Artificial Sequence
  Description of Artificial Sequence: Synthetic polypeptide
TSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 99 - protein, 216 aa, Artificial Sequence
  Description of Artificial Sequence: Synthetic polypeptide
PESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 100 - protein, 252 aa, Artificial Sequence
  Description of Artificial Sequence: Synthetic polypeptide
ESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSE

SEQ ID NO: 101 - protein, 288 aa, Artificial Sequence
  Description of Artificial Sequence: Synthetic polypeptide
TPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESA

SEQ ID NO: 102 - protein, 324 aa, Artificial Sequence
  Description of Artificial Sequence: Synthetic polypeptide
PESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 103 - protein, 360 aa, Artificial Sequence
  Description of Artificial Sequence: Synthetic polypeptide
PESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 104 - protein, 360 aa, Artificial Sequence
  Description of Artificial Sequence: Synthetic polypeptide
PESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPS

SEQ ID NO: 105 - protein, 432 aa, Artificial Sequence
  Description of Artificial Sequence: Synthetic polypeptide
EGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 106 - protein, 468 aa, Artificial Sequence
  Description of Artificial Sequence: Synthetic polypeptide
EGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 107 - protein, 504 aa, Artificial Sequence
  Description of Artificial Sequence: Synthetic polypeptide
EGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPS

SEQ ID NO: 108 - protein, 540 aa, Artificial Sequence
  Description of Artificial Sequence: Synthetic polypeptide
TPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEP

SEQ ID NO: 109 - protein, 576 aa, Artificial Sequence
  Description of Artificial Sequence: Synthetic polypeptide
TPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESA

SEQ ID NO: 110 - protein, 612 aa, Artificial Sequence
  Description of Artificial Sequence: Synthetic polypeptide
GSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 111 - protein, 648 aa, Artificial Sequence
  Description of Artificial Sequence: Synthetic polypeptide
PESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 112 - protein, 684 aa, Artificial Sequence
  Description of Artificial Sequence: Synthetic polypeptide
EGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 113 - protein, 720 aa, Artificial Sequence
  Description of Artificial Sequence: Synthetic polypeptide
TSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTE

SEQ ID NO: 114 - protein, 756 aa, Artificial Sequence
  Description of Artificial Sequence: Synthetic polypeptide
TSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSES

SEQ ID NO: 115 - protein, 792 aa, Artificial Sequence
  Description of Artificial Sequence: Synthetic polypeptide
EGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPS

SEQ ID NO: 116 - protein, 828 aa, Artificial Sequence
  Description of Artificial Sequence: Synthetic polypeptide
PESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 117 - protein, 72 aa, Artificial Sequence
  Description of Artificial Sequence: Synthetic polypeptide
GPGSSPSASTGTGPGTPGSGTASSSPGSSTPSGATGSPGSSPSASTGTGPGASPGTSSTGSPGTPGSGTASS

SEQ ID NO: 118 - protein, 72 aa, Artificial Sequence
  Description of Artificial Sequence: Synthetic polypeptide
GSSTPSGATGSPGSSTPSGATGSPGSSPSASTGTGPGSSPSASTGTGPGASPGTSSTGSPGTPGSGTASSSP

SEQ ID NO: 119 - protein, 72 aa, Artificial Sequence
  Description of Artificial Sequence: Synthetic polypeptide
SPSASTGTGPGASPGTSSTGSPGSSPSASTGTGPGTPGSGTASSSPGSSTPSGATGSPGSSTPSGATGSPGA

SEQ ID NO: 120 - protein, 108 aa, Artificial Sequence
  Description of Artificial Sequence: Synthetic polypeptide
SASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASP

SEQ ID NO: 121 - protein, 108 aa, Artificial Sequence
  Description of Artificial Sequence: Synthetic polypeptide
PGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSS

SEQ ID NO: 122 - protein, 144 aa, Artificial Sequence; identical to SEQ ID NO: 43
  Description of Artificial Sequence: Synthetic polypeptide

SEQ ID NO: 123 - protein, 144 aa, Artificial Sequence
  Description of Artificial Sequence: Synthetic polypeptide
PSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASP

SEQ ID NO: 124 - protein, 180 aa, Artificial Sequence
  Description of Artificial Sequence: Synthetic polypeptide
TSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGS

SEQ ID NO: 125 - protein, 216 aa, Artificial Sequence
  Description of Artificial Sequence: Synthetic polypeptide
TGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSG

SEQ ID NO: 126 - protein, 252 aa, Artificial Sequence
  Description of Artificial Sequence: Synthetic polypeptide
TSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPG

SEQ ID NO: 127 - protein, 288 aa, Artificial Sequence
  Description of Artificial Sequence: Synthetic polypeptide
TSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGS

SEQ ID NO: 128 - protein, 324 aa, Artificial Sequence
  Description of Artificial Sequence: Synthetic polypeptide
TSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTP

SEQ ID NO: 129 - protein, 360 aa, Artificial Sequence
  Description of Artificial Sequence: Synthetic polypeptide
TSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPG

SEQ ID NO: 130 - protein, 396 aa, Artificial Sequence
  Description of Artificial Sequence: Synthetic polypeptide
GATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGT

SEQ ID NO: 131 - protein, 432 aa, Artificial Sequence
  Description of Artificial Sequence: Synthetic polypeptide
GATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPS

SEQ ID NO: 132 - protein, 468 aa, Artificial Sequence
  Description of Artificial Sequence: Synthetic polypeptide
TSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPG

SEQ ID NO: 133 - protein, 504 aa, Artificial Sequence
  Description of Artificial Sequence: Synthetic polypeptide
TSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTP

SEQ ID NO: 134 - protein, 540 aa, Artificial Sequence
  Description of Artificial Sequence: Synthetic polypeptide
TSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPG

SEQ ID NO: 135 - protein, 576 aa, Artificial Sequence
  Description of Artificial Sequence: Synthetic polypeptide
TSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPG

SEQ ID NO: 136 - protein, 612 aa, Artificial Sequence
  Description of Artificial Sequence: Synthetic polypeptide
STGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTS

SEQ ID NO: 137 - protein, 648 aa, Artificial Sequence
  Description of Artificial Sequence: Synthetic polypeptide
GTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTP

SEQ ID NO: 138 - protein, 684 aa, Artificial Sequence
  Description of Artificial Sequence: Synthetic polypeptide
TSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPG

SEQ ID NO: 139 - protein, 720 aa, Artificial Sequence
  Description of Artificial Sequence: Synthetic polypeptide
TSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPG

SEQ ID NO: 140 - protein, 756 aa, Artificial Sequence
  Description of Artificial Sequence: Synthetic polypeptide
TSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPG

SEQ ID NO: 141 - protein, 792 aa, Artificial Sequence
  Description of Artificial Sequence: Synthetic polypeptide
TSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPG

SEQ ID NO: 142 - protein, 828 aa, Artificial Sequence
  Description of Artificial Sequence: Synthetic polypeptide
TSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTP

SEQ ID NO: 143 - protein, 48 aa, Artificial Sequence; identical to SEQ ID NO: 39
  Description of Artificial Sequence: Synthetic polypeptide

SEQ ID NO: 144 - protein, 48 aa, Artificial Sequence; identical to SEQ ID NO: 40
  Description of Artificial Sequence: Synthetic polypeptide

SEQ ID NO: 145 - protein, 6 aa, Artificial Sequence
  Description of Artificial Sequence: Synthetic peptide
GPEGPS

SEQ ID NO: 146 - protein, 4 aa, Artificial Sequence
  Description of Artificial Sequence: Synthetic peptide
GSPG

SEQ ID NO: 147 - protein, 4 aa, Artificial Sequence
  Description of Artificial Sequence: Synthetic peptide
ETET

SEQ ID NO: 148 - protein, 5 aa, Artificial Sequence
  Description of Artificial Sequence: Synthetic peptide
PGSSS

SEQ ID NO: 149 - protein, 5 aa, Artificial Sequence
  Description of Artificial Sequence: Synthetic peptide
GPSGP

SEQ ID NO: 150 - protein, 7 aa, Artificial Sequence
  Description of Artificial Sequence: Synthetic peptide
KLTRAET

SEQ ID NO: 151 - protein, 7 aa, Artificial Sequence
  Description of Artificial Sequence: Synthetic peptide
DFTRVVG

SEQ ID NO: 152 - protein, 8 aa, Artificial Sequence
  Description of Artificial Sequence: Synthetic peptide
TMTRIVGG

SEQ ID NO: 153 - protein, 8 aa, Artificial Sequence
  Description of Artificial Sequence: Synthetic peptide
SPFRSTGG

SEQ ID NO: 154 - protein, 8 aa, Artificial Sequence
  Description of Artificial Sequence: Synthetic peptide
LQVRIVGG

SEQ ID NO: 155 - protein, 8 aa, Artificial Sequence
  Description of Artificial Sequence: Synthetic peptide
PLGRIVGG

SEQ ID NO: 156 - protein, 8 aa, Artificial Sequence
  Description of Artificial Sequence: Synthetic peptide
IEGRTVGG

SEQ ID NO: 157 - protein, 8 aa, Artificial Sequence
  Description of Artificial Sequence: Synthetic peptide
LTPRSLLV

SEQ ID NO: 158 - protein, 8 aa, Artificial Sequence
  Description of Artificial Sequence: Synthetic peptide
LGPVSGVP

SEQ ID NO: 159 - protein, 8 aa, Artificial Sequence
  Description of Artificial Sequence: Synthetic peptide
VAGDSLEE

SEQ ID NO: 160 - protein, 8 aa, Artificial Sequence
  Description of Artificial Sequence: Synthetic peptide
GPAGLGGA

SEQ ID NO: 161 - protein, 8 aa, Artificial Sequence
  Description of Artificial Sequence: Synthetic peptide
  MOD_RES (2)..(2): Pro or Ala
  MOD_RES (3)..(3): Any amino acid
  MOD_RES (6)..(6): Any amino acid
  MOD_RES (8)..(8): Any amino acid
GXXGLXGX

SEQ ID NO: 162 - protein, 8 aa, Artificial Sequence
  Description of Artificial Sequence: Synthetic peptide
GPAGLRGA

SEQ ID NO: 163 - protein, 8 aa, Artificial Sequence
  Description of Artificial Sequence: Synthetic peptide
  MOD_RES (3)..(3): Any amino acid
  MOD_RES (6)..(6): Any amino acid
  MOD_RES (7)..(7): Gly or Ala
  MOD_RES (8)..(8): Any amino acid
GPXGLXXX

SEQ ID NO: 164 - protein, 8 aa, Artificial Sequence
  Description of Artificial Sequence: Synthetic peptide
APLGLRLR

SEQ ID NO: 165 - protein, 8 aa, Artificial Sequence
  Description of Artificial Sequence: Synthetic peptide
PALPLVAQ

SEQ ID NO: 166 - protein, 7 aa, Artificial Sequence
  Description of Artificial Sequence: Synthetic peptide
ENLYFQG

SEQ ID NO: 167 - protein, 8 aa, Artificial Sequence
  Description of Artificial Sequence: Synthetic peptide
ENLYFQGS

SEQ ID NO: 168 - protein, 8 aa, Artificial Sequence
  Description of Artificial Sequence: Synthetic peptide
DDDKIVGG

SEQ ID NO: 169 - protein, 8 aa, Artificial Sequence
  Description of Artificial Sequence: Synthetic peptide
DDDKIVGG

SEQ ID NO: 170 - protein, 8 aa, Artificial Sequence
  Description of Artificial Sequence: Synthetic peptide
LEVLFQGP

SEQ ID NO: 171 - protein, 8 aa, Artificial Sequence
  Description of Artificial Sequence: Synthetic peptide
LEVLFQGP

SEQ ID NO: 172 - protein, 8 aa, Artificial Sequence
  Description of Artificial Sequence: Synthetic peptide
LPKTGSES

SEQ ID NO: 173 - protein, 8 aa, Artificial Sequence
  Description of Artificial Sequence: Synthetic peptide
  MOD_RES (3)..(3): Lys, Glu, Ala or Asp
  MOD_RES (6)..(6): Any amino acid
  MOD_RES (7)..(7): Glu, Lys or Ser
LPXTGXXS

SEQ ID NO: 174 - protein, 11 aa, Artificial Sequence
  Description of Artificial Sequence: Synthetic peptide
GGSPAGSCTSP

SEQ ID NO: 175 - protein, 11 aa, Artificial Sequence
  Description of Artificial Sequence: Synthetic peptide
GASASCAPSTG

SEQ ID NO: 176 - protein, 11 aa, Artificial Sequence
  Description of Artificial Sequence: Synthetic peptide
GPEPTCPAPSG

SEQ ID NO: 177 - protein, 11 aa, Artificial Sequence
  Description of Artificial Sequence: Synthetic peptide
GGSPAGSKTSP

SEQ ID NO: 178 - protein, 11 aa, Artificial Sequence
  Description of Artificial Sequence: Synthetic peptide
GASASKAPSTG

SEQ ID NO: 179 - protein, 734 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGGGSPAGSCTSPGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPG

SEQ ID NO: 180 - protein, 1071 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGASASCAPSTGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPG

SEQ ID NO: 181 - protein, 878 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGGGSPAGSCTSPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 182 - protein, 927 aa, Artificial Sequence
  Description of Artificial Sequence: Synthetic polypeptide
MAEPAGSPTSTEEGTPGSGTASSSPGSSTPSGATGSPGASPGTSSTGSPGGPEPTCPAPSGGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 183 - protein, 891 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGGSPAGSCTSPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGGSPAGSCTSPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 184 - protein, 796 aa, Artificial Sequence
  Description of Artificial Sequence: Synthetic polypeptide
MAEPAGSPTSTEEGTPGSGTASSSPGSSTPSGATGSPGASPGTSSTGSPGGASASCAPSTGGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGGASASCAPSTGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPG

SEQ ID NO: 185 - protein, 938 aa, Artificial Sequence
  Description of Artificial Sequence: Synthetic polypeptide
MAEPAGSPTSTEEGASPGTSSTGSPGSSTPSGATGSPGSSTPSGATGSPGGGSPAGSCTSPGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPG

SEQ ID NO: 186 - protein, 1381 aa, Artificial Sequence
  Description of Artificial Sequence: Synthetic polypeptide
MAEPAGSPTSTEEGASPGTSSTGSPGSSTPSGATGSPGSSTPSGATGSPGGASASCAPSTGGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPG

SEQ ID NO: 187 - protein, 938 aa, Artificial Sequence
  Description of Artificial Sequence: Synthetic polypeptide
MAEPAGSPTSTEEGASPGTSSTGSPGSSTPSGATGSPGSSTPSGATGSPGGPEPTCPAPSGGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPG

SEQ ID NO: 188 - protein, 1000 aa, Artificial Sequence
  Description of Artificial Sequence: Synthetic polypeptide
MAEPAGSPTSTEEGASPGTSSTGSPGSSTPSGATGSPGSSTPSGATGSPGGPEPTCPAPSGGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGGPEPTCPAPSGGMAEPAGSPTSTEEGASPGTSSTGSPGSSTPSGATGSPGSSTPSGATGSPG

SEQ ID NO: 189 - protein, 734 aa, Artificial Sequence
  Description of Artificial Sequence: Synthetic polypeptide
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGGGSPAGSKTSPGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPG

SEQ ID NO: 190 - protein, 1071 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGASASKAPSTGGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPG

SEQ ID NO: 191 - protein, 878 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGGGSPAGSKTSPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 192 - protein, 927 aa, Artificial Sequence
  Description of Artificial Sequence: Synthetic polypeptide
MAEPAGSPTSTEEGTPGSGTASSSPGSSTPSGATGSPGASPGTSSTGSPGGASASKAPSTGGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 193 - protein, 891 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGGSPAGSKTSPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGGSPAGSKTSPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 194 - protein, 796 aa, Artificial Sequence
  Description of Artificial Sequence: Synthetic polypeptide
MAEPAGSPTSTEEGTPGSGTASSSPGSSTPSGATGSPGASPGTSSTGSPGGGSPAGSKTSPGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGGGSPAGSKTSPGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPG

SEQ ID NO: 195 - protein, 938 aa, Artificial Sequence
  Description of Artificial Sequence: Synthetic polypeptide
MAEPAGSPTSTEEGASPGTSSTGSPGSSTPSGATGSPGSSTPSGATGSPGGGSPAGSKTSPGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPG

SEQ ID NO: 196 - protein, 1381 aa, Artificial Sequence
  Description of Artificial Sequence: Synthetic polypeptide
MAEPAGSPTSTEEGASPGTSSTGSPGSSTPSGATGSPGSSTPSGATGSPGGASASKAPSTGGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPG

SEQ ID NO: 197 - protein, 938 aa, Artificial Sequence
  Description of Artificial Sequence: Synthetic polypeptide
MAEPAGSPTSTEEGASPGTSSTGSPGSSTPSGATGSPGSSTPSGATGSPGGASASKAPSTGGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPG

SEQ ID NO: 198 - protein, 1000 aa, Artificial Sequence
  Description of Artificial Sequence: Synthetic polypeptide
MAEPAGSPTSTEEGASPGTSSTGSPGSSTPSGATGSPGSSTPSGATGSPGGASASKAPSTGGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGGASASKAPSTGGMAEPAGSPTSTEEGASPGTSSTGSPGSSTPSGATGSPGSSTPSGATGSPG

SEQ ID NO: 199 - protein, 891 aa, Artificial Sequence
  Description of Artificial Sequence: Synthetic polypeptide
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGGSPAGSCTSPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGGGSPAGSKTSPGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 200 - protein, 677 aa, Artificial Sequence
  Description of Artificial Sequence: Synthetic polypeptide
MAEPAGSPTSTEEGTPGSGTASSSPGSSTPSGATGSPGASPGTSSTGSPGGGSPAGSCTSPGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGGGSPAGSCTSPGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGGGSPAGSCTSPGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGGGSPAGSCTSPGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPG

SEQ ID NO: 201 - protein, 677 aa, Artificial Sequence
  Description of Artificial Sequence: Synthetic polypeptide
MAEPAGSPTSTEEGTPGSGTASSSPGSSTPSGATGSPGASPGTSSTGSPGGGSPAGSKTSPGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGGGSPAGSKTSPGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGGGSPAGSKTSPGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGGGSPAGSKTSPGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPG

SEQ ID NO: 202 - DNA, 432 bp, Artificial Sequence
  Description of Artificial Sequence: Synthetic polynucleotide
ggtagcgaaccggcaacttccggctctgaaaccccaggtacttctgaaagcgctactcctgagtctggcccaggtagcgaacctgctacctctggctctgaaaccccaggtagcccggcaggctctccgacttccaccgaggaaggtacctctactgaaccttctgagggtagcgctccaggtagcgaaccggcaacctctggctctgaaaccccaggtagcgaacctgctacctccggctctgaaactccaggtagcgaaccggctacttccggttctgaaactccaggtacctctaccgaaccttccgaaggcagcgcaccaggtacttctgaaagcgcaacccctgaatccggtccaggtagcgaaccggctacttctggctctgagactccaggtacttctaccgaaccgtccgaaggtagcgcacca

SEQ ID NO: 203 - DNA, 432 bp, Artificial Sequence
  Description of Artificial Sequence: Synthetic polynucleotide
ggtacttctactccggaaagcggttccgcatctccaggtacttctcctagcggtgaatcttctactgctccaggtacctctcctagcggcgaatcttctactgctccaggttctaccagctctaccgctgaatctcctggcccaggttctaccagcgaatccccgtctggcaccgcaccaggttctactagctctaccgcagaatctccgggtccaggtacttcccctagcggtgaatcttctactgctccaggtacctctactccggaaagcggctccgcatctccaggttctactagctctactgctgaatctcctggtccaggtacctcccctagcggcgaatcttctactgctccaggtacctctcctagcggcgaatcttctaccgctccaggtacctcccctagcggtgaatcttctaccgcacca

SEQ ID NO: 204 - DNA, 864 bp, Artificial Sequence
  Description of Artificial Sequence: Synthetic polynucleotide
ggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 205 - DNA, 1728 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcacca

SEQ ID NO: 206 - DNA, 1728 bp, Artificial Sequence
  Description of Artificial Sequence: Synthetic polynucleotide
ggttctactagctctaccgctgaatctcctggcccaggttccactagctctaccgcagaatctccgggcccaggttctactagcgaatccccttctggtaccgctccaggttctactagctctaccgctgaatctccgggtccaggttctaccagctctactgcagaatctcctggcccaggtacttctactccggaaagcggttccgcttctccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctaccagcgaatctccttctggcaccgctccaggtacctctcctagcggcgaatcttctaccgctccaggttctactagcgaatctccttctggcactgcaccaggttctactagcgaatctccttctggcactgcaccaggttctaccagcgaatctccgtctggcactgcaccaggtacctctacccctgaaagcggttccgcttctccaggttctactagcgaatctccttctggtaccgctccaggtacttctacccctgaaagcggctccgcttctccaggttccactagctctaccgctgaatctccgggtccaggttctactagctctactgcagaatctcctggcccaggtacctctactccggaaagcggctctgcatctccaggtacttctacccctgaaagcggttctgcatctccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggttctaccagcgaatccccgtctggtactgctccaggttctaccagcgaatctccttctggtactgcaccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctactagcgaatctccttctggcactgcaccaggttctaccagcgaatctccgtctggcactgcaccaggtacctctacccctgaaagcggttccgcttctccaggtacttctccgagcggtgaatcttctaccgcaccaggttctactagctctaccgctgaatctccgggcccaggtacttctccgagcggtgaatcttctactgctccaggttccactagctctactgctgaatctcctggcccaggtacttctactccggaaagcggttccgcttctccaggttctactagcgaatctccgtctggcaccgcaccaggttctactagctctactgcagaatctcctggcccaggtacctctactccggaaagcggctctgcatctccaggtacttctacccctgaaagcggttctgcatctcca

SEQ ID NO: 207 - DNA, 2625 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcacca

SEQ ID NO: 208 - DNA, 2592 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 209 - DNA, 2625 bp, Artificial Sequence
  Description of Artificial Sequence: Synthetic polynucleotide
  modified_base (1287)..(1298): a, c, t, g, unknown or other
  modified_base (1330)..(1337): a, c, t, g, unknown or other
ggttctaccagcgaatctccttctggcaccgctccaggtacctctcctagcggcgaatcttctaccgctccaggttctactagcgaatctccttctggcactgcaccaggttctactagcgaatccccgtctggtactgctccaggtacttctactcctgaaagcggttccgcttctccaggtacctctactccggaaagcggttctgcatctccaggttctaccagcgaatctccttctggcaccgctccaggttctactagcgaatccccgtctggtaccgcaccaggtacttctcctagcggcgaatcttctaccgcaccaggttctactagcgaatctccgtctggcactgctccaggtacttctcctagcggtgaatcttctaccgctccaggtacttcccctagcggcgaatcttctaccgctccaggttctactagctctactgcagaatctccgggcccaggtacctctcctagcggtgaatcttctaccgctccaggtacttctccgagcggtgaatcttctaccgctccaggttctactagctctactgcagaatctcctggcccaggtacctctactccggaaagcggctctgcatctccaggtacttctacccctgaaagcggttctgcatctccaggttctactagcgaatctccttctggcactgcaccaggttctaccagcgaatctccgtctggcactgcaccaggtacctctacccctgaaagcggttccgcttctccaggttctaccagctctaccgcagaatctcctggtccaggtacctctactccggaaagcggctctgcatctccaggttctactagcgaatctccttctggcactgcaccaggtacttctccgagcggtgaatcttctaccgcaccaggttctactagctctaccgctgaatctccgggcccaggtacttctccgagcggtgaatcttctactgctccaggtacctctactcctgaaagcggttctgcatctccaggttccactagctctaccgcagaatctccgggcccaggttctactagctctactgctgaatctcctggcccaggttctactagctctactgctgaatctccgggtccaggttctaccagctctactgctgaatctcctggtccaggtacctccccgagcggtgaatcttctactgcaccaggttctactagcgaatctccttctggcactgcaccaggttctaccagcgaatctccgtctggcactgcaccaggtacctctacccctgaaagcggtccnnnnnnnnnnnntgcaagcgcaagcggcgcgccaagcacgggannnnnnnntagcgaatctccttctggtaccgctccaggttctaccagcgaatccccgtctggtactgctccaggttctaccagcgaatctccttctggtactgcaccaggttctactagcgaatctccttctggtaccgctccaggttctaccagcgaatccccgtctggtactgctccaggttctaccagcgaatctccttctggtactgcaccaggtacttctactccggaaagcggttccgcatctccaggtacttctcctagcggtgaatcttctactgctccaggtacctctcctagcggcgaatcttctactgctccaggttctaccagctctactgctgaatctccgggtccaggtacttccccgagcggtgaatcttctactgcaccaggtacttctactccggaaagcggttccgcttctccaggttctaccagcgaatctccttctggcaccgctccaggttctactagcgaatccccgtctggtaccgcaccaggtacttctcctagcggcgaatcttctaccgcaccaggttctactagcgaatccccgtctggtaccgcaccaggtacttctaccccggaaagcggctctgcttctccaggtacttctaccccggaaagcggctccgcatctccaggttctactagcgaatctccttctggtaccgctccaggtacttctacccctgaaagcggctccgcttctccaggttccactagctctaccgctgaatctccgggtccaggttctaccagcgaatctccttctggcaccgctccaggttctactagcgaatccccgtctggtaccgcaccaggtacttctcctagcggcgaatcttctaccgcaccaggttctaccagctctactgctgaatctccgggtccaggtacttccccgagcggtgaatcttctactgcaccaggtacttctactccggaaagcggttccgcttctccaggtacctcccctagcggcgaatcttctactgctccaggtacctctcctagcggcgaatcttctaccgctccaggtacctcccctagcggtgaatcttctaccgcaccaggttctactagctctactgctgaatctccgggtccaggttctaccagctctactgctgaatctcctggtccaggtacctccccgagcggtgaatcttctactgcaccaggttctagcccttctgcttccaccggtaccggcccaggtagctctactccgtctggtgcaactggctctccaggtagctctactccgtctggtgcaaccggctcccca

SEQ ID NO: 210 - DNA, 2592 bp, Artificial Sequence
  Description of Artificial Sequence: Synthetic polynucleotide
ggtgcttccccgggcaccagctctactggttctccaggttctagcccgtctgcttctactggtactggtccaggttctagcccttctgcttccactggtactggtccaggtaccccgggtagcggtaccgcttcttcttctccaggtagctctactccgtctggtgctaccggctctccaggttctaacccttctgcatccaccggtaccggcccaggtgcttctccgggcaccagctctactggttctccaggtaccccgggcagcggtaccgcatcttcttctccaggtagctctactccttctggtgcaactggttctccaggtactcctggcagcggtaccgcttcttcttctccaggtgcttctcctggtactagctctactggttctccaggtgcttctccgggcactagctctactggttctccaggtaccccgggtagcggtactgcttcttcctctccaggtagctctaccccttctggtgcaaccggctctccaggtgcttctccgggcaccagctctaccggttctccaggtaccccgggtagcggtaccgcttcttcttctccaggtagctctactccgtctggtgctaccggctctccaggttctaacccttctgcatccaccggtaccggcccaggttctagcccttctgcttccaccggtactggcccaggtagctctaccccttctggtgctaccggctccccaggtagctctactccttctggtgcaactggctctccaggtgcatctccgggcactagctctactggttctccaggtgcatcccctggcactagctctactggttctccaggtgcttctcctggtaccagctctactggttctccaggtactcctggcagcggtaccgcttcttcttctccaggtgcttctcctggtactagctctactggttctccaggtgcttctccgggcactagctctactggttctccaggtgcttccccgggcactagctctaccggttctccaggttctagcccttctgcatctactggtactggcccaggtactccgggcagcggtactgcttcttcctctccaggtgcatctccgggcactagctctactggttctccaggtgcatcccctggcactagctctactggttctccaggtgcttctcctggtaccagctctactggttctccaggtagctctactccgtctggtgcaaccggttccccaggtagctctactccttctggtgctactggctccccaggtgcatcccctggcaccagctctaccggttctccaggtaccccgggcagcggtaccgcatcttcctctccaggtagctctaccccgtctggtgctaccggttccccaggtagctctaccccgtctggtgcaaccggctccccaggtagctctactccgtctggtgcaaccggctccccaggttctagcccgtctgcttccactggtactggcccaggtgcttccccgggcaccagctctactggttctccaggtgcatccccgggtaccagctctaccggttctccaggtactcctggcagcggtactgcatcttcctctccaggtgcttctccgggcaccagctctactggttctccaggtgcatctccgggcactagctctactggttctccaggtgcatcccctggcactagctctactggttctccaggtgcttctcctggtaccagctctactggttctccaggtacccctggtagcggtactgcttcttcctctccaggtagctctactccgtctggtgctaccggttctccaggtaccccgggtagcggtaccgcatcttcttctccaggtagctctaccccgtctggtgctactggttctccaggtactccgggcagcggtactgcttcttcctctccaggtagctctaccccttctggtgctactggctctccaggtagctctaccccgtctggtgctactggctccccaggttctagcccttctgcatccaccggtaccggtccaggttctagcccgtctgcatctactggtactggtccaggtgcatccccgggcactagctctaccggttctccaggtactcctggtagcggtactgcttcttcttctccaggtagctctactccttctggtgctactggttctccaggttctagcccttctgcatccaccggtaccggcccaggttctagcccgtctgcttctaccggtactggtccaggtgcttctccgggtactagctctactggttctccaggtgcatctcctggtactagctctactggttctccaggtagctctactccgtctggtgcaaccggctctccaggttctagcccttctgcatctaccggtactggtccaggtgcatcccctggtaccagctctaccggttctccaggttctagcccttctgcttctaccggtaccggtccaggtacccctggcagcggtaccgcatcttcctctccaggtagctctactccgtctggtgcaaccggttccccaggtagctctactccttctggtgctactggctccccaggtgcatcccctggcaccagctctaccggttctcca

SEQ ID NO: 211 - DNA, 2772 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtgcaagcgcaagcggcgcgccaagcacgggaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggtacccctggcagcggtaccgcttcttcctctccaggtagctctaccccgtctggtgctactggctctccaggttctagcccgtctgcatctaccggtaccggcccaggtagcgaaccggcaacctccggctctgaaactccaggtacttctgaaagcgctactccggaatccggcccaggtagcgaaccggctacttccggctctgaaaccccaggttccaccagctctactgcagaatctccgggcccaggttctactagctctactgcagaatctccgggtccaggtacttctcctagcggcgaatcttctaccgctccaggtagcgaaccggcaacctctggctctgaaactccaggtagcgaacctgcaacctccggctctgaaaccccaggtacttctactgaaccttctgagggcagcgcaccaggttctaccagctctaccgcagaatctcctggtccaggtacctctactccggaaagcggctctgcatctccaggttctactagcgaatctccttctggcactgcaccaggtacttctaccgaaccgtccgaaggcagcgctccaggtacctctactgaaccttccgagggcagcgctccaggtacctctaccgaaccttctgaaggtagcgcaccaggtagctctactccgtctggtgcaaccggctccccaggttctagcccgtctgcttccactggtactggcccaggtgcttccccgggcaccagctctactggttctccaggtagcgaacctgctacctccggttctgaaaccccaggtacctctgaaagcgcaactccggagtctggtccaggtagccctgcaggttctcctacctccactgaggaaggtagctctactccgtctggtgcaaccggctccccaggttctagcccgtctgcttccactggtactggcccaggtgcttccccgggcaccagctctactggttctccaggtacctctgaaagcgctactccggagtctggcccaggtacctctactgaaccgtctgagggtagcgctccaggtacttctactgaaccgtccgaaggtagcgcacca

SEQ ID NO: 212 - DNA, 2739 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 213 - DNA, 3954 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaaggttctaccagctctaccgcagaatctcctggtccaggtacctctactccggaaagcggctctgcatctccaggttctactagcgaatctccttctggcactgcaccaggttctactagcgaatccccgtctggtactgctccaggtacttctactcctgaaagcggttccgcttctccaggtacctctactccggaaagcggttctgcatctccaggtagcgaaccggcaacctccggctctgaaaccccaggtacctctgaaagcgctactcctgaatccggcccaggtagcccggcaggttctccgacttccactgaggaaggtacctctactgaaccttctgagggcagcgctccaggtacttctgaaagcgctaccccggagtccggtccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtacttctaccgaaccttccgagggcagcgcaccaggtacttctgaaagcgctacccctgagtccggcccaggtacttctgaaagcgctactcctgaatccggtccaggtacctctactgaaccttccgaaggcagcgctccaggtacctctaccgaaccgtccgagggcagcgcaccaggtacttctgaaagcgcaacccctgaatccggtccaggtacttctactgaaccttccgaaggtagcgctccaggtagcgaacctgctacttctggttctgaaaccccaggtagcccggctggctctccgacctccaccgaggaaggtagctctaccccgtctggtgctactggttctccaggtactccgggcagcggtactgcttcttcctctccaggtagctctaccccttctggtgctactggctctccaggtacctctaccgaaccgtccgagggtagcgcaccaggtacctctactgaaccgtctgagggtagcgctccaggtagcgaaccggcaacctccggttctgaaactccaggtagccctgctggctctccgacttctactgaggaaggtagcccggctggttctccgacttctactgaggaaggtacttctaccgaaccttccgaaggtagcgctccaggtccagaaccaacggggccggccccaagcggaggtagcgaaccggcaacctccggctctgaaaccccaggtacctctgaaagcgctactcctgaatccggcccaggtagcccggcaggttctccgacttccactgaggaaggtacttctgaaagcgctactcctgagtccggcccaggtagcccggctggctctccgacttccaccgaggaaggtagcccggctggctctccaacttctactgaagaaggtacttctgaaagcgctactcctgagtccggcccaggtagcccggctggctctccgacttccaccgaggaaggtagcccggctggctctccaacttctactgaagaaggttctaccagctctaccgctgaatctcctggcccaggttctactagcgaatctccgtctggcaccgcaccaggtacttcccctagcggtgaatcttctactgcaccaggttctaccagcgaatctccttctggcaccgctccaggttctactagcgaatccccgtctggtaccgcaccaggtacttctcctagcggcgaatcttctaccgcaccaggtacttctaccgaaccttccgagggcagcgcaccaggtacttctgaaagcgctacccctgagtccggcccaggtacttctgaaagcgctactcctgaatccggtccaggtagcgaaccggcaacctctggctctgaaaccccaggtacctctgaaagcgctactccggaatctggtccaggtacttctgaaagcgctactccggaatccggtccaggtacctctactgaaccttctgagggcagcgctccaggtacttctgaaagcgctaccccggagtccggtccaggtacttctactgaaccgtccgaaggtagcgcaccaggtacctcccctagcggcgaatcttctactgctccaggtacctctcctagcggcgaatcttctaccgctccaggtacctcccctagcggtgaatcttctaccgcaccaggtacttctaccgaaccgtccgagggtagcgcaccaggtagcccagcaggttctcctacctccaccgaggaaggtacttctaccgaaccgtccgagggtagcgcaccaggttctagcccttctgcttccaccggtaccggcccaggtagctctactccgtctggtgcaactggctctccaggtagctctactccgtctggtgcaaccggctccccaggtagctctaccccgtctggtgctaccggctctccaggtagctctaccccgtctggtgcaaccggctccccaggtgcatccccgggtactagctctaccggttctccaggtgcaagcgcaagcggcgcgccaagcacgggaggtacttctccgagcggtgaatcttctaccgcaccaggttctactagctctaccgctgaatctccgggcccaggtacttctccgagcggtgaatcttctactgctccaggtacctctgaaagcgctactccggagtctggcccaggtacctctactgaaccgtctgagggtagcgctccaggtacttctactgaaccgtccgaaggtagcgcaccaggttctagcccttctgcatctactggtactggcccaggtagctctactccttctggtgctaccggctctccaggtgcttctccgggtactagctctaccggttctccaggtacttctactccggaaagcggttccgcatctccaggtacttctcctagcggtgaatcttctactgctccaggtacctctcctagcggcgaatcttctactgctccaggtacttctgaaagcgcaacccctgaatccggtccaggtagcgaaccggctacttctggctctgagactccaggtacttctaccgaaccgtccgaaggtagcgcaccaggttctaccagcgaatccccttctggtactgctccaggttctaccagcgaatccccttctggcaccgcaccaggtacttctacccctgaaagcggctccgcttctccaggtagcccggcaggctctccgacctctactgaggaaggtacttctgaaagcgcaaccccggagtccggcccaggtacctctaccgaaccgtctgagggcagcgcaccaggtagccctgctggctctccaacctccaccgaagaaggtacctctgaaagcgcaacccctgaatccggcccaggtagcgaaccggcaacctccggttctgaaaccccaggtagctctaccccgtctggtgctaccggttccccaggtgcttctcctggtactagctctaccggttctccaggtagctctaccccgtctggtgctactggctctccaggttctactagcgaatccccgtctggtactgctccaggtacttcccctagcggtgaatcttctactgctccaggttctaccagctctaccgcagaatctccgggtccaggtagctctaccccttctggtgcaaccggctctccaggtgcatccccgggtaccagctctaccggttctccaggtactccgggtagcggtaccgcttcttcctctccaggtagccctgctggctctccgacttctactgaggaaggtagcccggctggttctccgacttctactgaggaaggtacttctaccgaaccttccgaaggtagcgctcca

SEQ ID NO: 214 - DNA, 2592 bp, Artificial Sequence
  Description of Artificial Sequence: Synthetic polynucleotide
ggtacttccaccgaaccatccgaaccaggtagcgcaggtacttccaccgaaccatccgaacctggcagcgcaggtagcgaaccggcaacctctggtactgaaccatcaggtagcggcgcatccgagcctacctctactgaaccaggtagcgaaccggctacctccggtactgagccatcaggtagcgaaccggcaacttccggtactgaaccatcaggtagcgaaccggcaacttccggcactgaaccatcaggtagcggtgcatctgagccgacctctactgaaccaggtacttctactgaaccatctgagccgggcagcgcaggtagcgaaccagctacttctggcactgaaccatcaggtacttctactgaaccatccgaaccaggtagcgcaggtagcgaacctgctacctctggtactgagccatcaggtagcgaaccggctacctctggtactgaaccatcaggtacttctaccgaaccatccgagcctggtagcgcaggtacttctaccgaaccatccgagccaggcagcgcaggtagcgaaccggcaacctctggcactgagccatcaggtagcgaaccagcaacttctggtactgaaccatcaggtactagcgagccatctacttccgaaccaggtgcaggtagcggcgcatccgaacctacttccactgaaccaggtactagcgagccatccacctctgaaccaggtgcaggtagcgaaccggcaacttccggcactgaaccatcaggtagcgaaccggctacctctggtactgaaccatcaggtacttctaccgaaccatccgagcctggtagcgcaggtacttctaccgaaccatccgagccaggcagcgcaggtagcggtgcatccgagccgacctctactgaaccaggtagcgaaccagcaacttctggcactgagccatcaggtagcgaaccagctacctctggtactgaaccatcaggtagcgaaccggctacttccggcactgaaccatcaggtagcgaaccagcaacctccggtactgaaccatcaggtacttccactgaaccatccgaaccgggtagcgcaggtagcgaaccggcaacttccggcactgaaccatcaggtagcggtgcatctgagccgacctctactgaaccaggtacttctactgaaccatctgagccgggcagcgcaggtagcgaacctgcaacctccggcactgagccatcaggtagcggcgcatctgaaccaacctctactgaaccaggtacttccaccgaaccatctgagccaggcagcgcaggtagcggcgcatctgaaccaacctctactgaaccaggtagcgaaccagcaacttctggtactgaaccatcaggtagcggcgcatctgagcctacttccactgaaccaggtagcgaaccggcaacttccggcactgaaccatcaggtagcggtgcatctgagccgacctctactgaaccaggtacttctactgaaccatctgagccgggcagcgcaggtagcgaaccggcaacttccggcactgaaccatcaggtagcggtgcatctgagccgacctctactgaaccaggtacttctactgaaccatctgagccgggcagcgcaggtagcgaaccagctacttctggcactgaaccatcaggtacttctactgaaccatccgaaccaggtagcgcaggtagcgaacctgctacctctggtactgagccatcaggtacttctactgaaccatccgagccgggtagcgcaggtacttccactgaaccatctgaacctggtagcgcaggtacttccactgaaccatccgaaccaggtagcgcaggtacttctactgaaccatccgagccgggtagcgcaggtacttccactgaaccatctgaacctggtagcgcaggtacttccactgaaccatccgaaccaggtagcgcaggtactagcgaaccatccacctccgaaccaggcgcaggtagcggtgcatctgaaccgacttctactgaaccaggtacttccactgaaccatctgagccaggtagcgcaggtacttccaccgaaccatccgaaccaggtagcgcaggtacttccaccgaaccatccgaacctggcagcgcaggtagcgaaccggcaacctctggtactgaaccatcaggtagcggtgcatccgagccgacctctactgaaccaggtagcgaaccagcaacttctggcactgagccatcaggtagcgaaccagctacctctggtactgaaccatcaggtagcgaaccggcaacctctggcactgagccatcaggtagcgaaccagcaacttctggtactgaaccatcaggtactagcgagccatctacttccgaaccaggtgcaggtagcgaacctgcaacctccggcactgagccatcaggtagcggcgcatctgaaccaacctctactgaaccaggtacttccaccgaaccatctgagccaggcagcgcaggtagcgaacctgcaacctccggcactgagccatcaggtagcggcgcatctgaaccaacctctactgaaccaggtacttccaccgaaccatctgagccaggcagcgca

SEQ ID NO: 215 - DNA, 2592 bp, Artificial Sequence
  Description of Artificial Sequence: Synthetic polynucleotide
ggtagcgaaactgctacttccggctctgagactgcaggtactagtgaatccgcaactagcgaatctggcgcaggtagcactgcaggctctgagacttccactgaagcaggtactagcgagtccgcaaccagcgaatccggcgcaggtagcgaaactgctacctctggctccgagactgcaggtagcgaaactgcaacctctggctctgaaactgcaggtacttccactgaagcaagtgaaggctccgcatcaggtacttccaccgaagcaagcgaaggctccgcatcaggtactagtgagtccgcaactagcgaatccggtgcaggtagcgaaaccgctacctctggttccgaaactgcaggtacttctaccgaggctagcgaaggttctgcatcaggtagcactgctggttccgagacttctactgaagcaggtactagcgaatctgctactagcgaatccggcgcaggtactagcgaatccgctaccagcgaatccggcgcaggtagcgaaactgcaacctctggttccgagactgcaggtactagcgagtccgctactagcgaatctggcgcaggtacttccactgaagctagtgaaggttctgcatcaggtagcgaaactgctacttctggttccgaaactgcaggtagcgaaaccgctacctctggttccgaaactgcaggtacttctaccgaggctagcgaaggttctgcatcaggtagcactgctggttccgagacttctactgaagcaggtactagcgagtccgctactagcgaatctggcgcaggtacttccactgaagctagtgaaggttctgcatcaggtagcgaaactgctacttctggttccgaaactgcaggtagcactgctggctccgagacttctaccgaagcaggtagcactgcaggttccgaaacttccactgaagcaggtagcgaaactgctacctctggctctgagactgcaggtactagcgaatctgctactagcgaatccggcgcaggtactagcgaatccgctaccagcgaatccggcgcaggtagcgaaactgcaacctctggttccgagactgcaggtactagcgaatctgctactagcgaatccggcgcaggtactagcgaatccgctaccagcgaatccggcgcaggtagcgaaactgcaacctctggttccgagactgcaggtagcgaaaccgctacctctggttccgaaactgcaggtacttctaccgaggctagcgaaggttctgcatcaggtagcactgctggttccgagacttctactgaagcaggtagcgaaactgctacttccggctctgagactgcaggtactagtgaatccgcaactagcgaatctggcgcaggtagcactgcaggctctgagacttccactgaagcaggtagcactgctggttccgaaacctctaccgaagcaggtagcactgcaggttctgaaacctccactgaagcaggtacttccactgaggctagtgaaggctctgcatcaggtagcactgctggttccgaaacctctaccgaagcaggtagcactgcaggttctgaaacctccactgaagcaggtacttccactgaggctagtgaaggctctgcatcaggtagcactgcaggttctgagacttccaccgaagcaggtagcgaaactgctacttctggttccgaaactgcaggtacttccactgaagctagtgaaggttccgcatcaggtactagtgagtccgcaaccagcgaatccggcgcaggtagcgaaaccgcaacctccggttctgaaactgcaggtactagcgaatccgcaaccagcgaatctggcgcaggtactagtgagtccgcaaccagcgaatccggcgcaggtagcgaaaccgcaacctccggttctgaaactgcaggtactagcgaatccgcaaccagcgaatctggcgcaggtagcgaaactgctacttccggctctgagactgcaggtacttccaccgaagcaagcgaaggttccgcatcaggtacttccaccgaggctagtgaaggctctgcatcaggtagcactgctggctccgagacttctaccgaagcaggtagcactgcaggttccgaaacttccactgaagcaggtagcgaaactgctacctctggctctgagactgcaggtactagcgaatctgctactagcgaatccggcgcaggtactagcgaatccgctaccagcgaatccggcgcaggtagcgaaactgcaacctctggttccgagactgcaggtagcgaaactgctacttccggctccgagactgcaggtagcgaaactgctacttctggctccgaaactgcaggtacttctactgaggctagtgaaggttccgcatcaggtactagcgagtccgcaaccagcgaatccggcgcaggtagcgaaactgctacctctggctccgagactgcaggtagcgaaactgcaacctctggctctgaaactgcaggtactagcgaatctgctactagcgaatccggcgcaggtactagcgaatccgctaccagcgaatccggcgcaggtagcgaaactgcaacctctggttccgagactgca

SEQ ID NO: 216 - DNA, 37 bp, Artificial Sequence
  Description of Artificial Sequence: Synthetic oligonucleotide
aggtgcaagcgcaagcggcgcgccaagcacgggaggt

SEQ ID NO: 217 - DNA, 37 bp, Artificial Sequence
  Description of Artificial Sequence: Synthetic oligonucleotide
aggtccagaaccaacggggccggccccaagcggaggt

SEQ ID NO: 218 - protein, 6 aa, Artificial Sequence
  Description of Artificial Sequence: Synthetic 6xHis tag
HHHHHH

SEQ ID NO: 219 - protein, 4 aa, Artificial Sequence
  Description of Artificial Sequence: Synthetic peptide
DDDK

SEQ ID NO: 220 - protein, 6 aa, Artificial Sequence
  Description of Artificial Sequence: Synthetic peptide
LVPRGS

SEQ ID NO: 221 - protein, 8 aa, Artificial Sequence
  Description of Artificial Sequence: Synthetic peptide
LEVLFQGP

SEQ ID NO: 222 - protein, 7 aa, Artificial Sequence
  Description of Artificial Sequence: Synthetic peptide
EQLYFQG

SEQ ID NO: 223 - protein, 7 aa, Artificial Sequence
  Description of Artificial Sequence: Synthetic peptide
ETLFQGP

SEQ ID NO: 224 - protein, 5 aa, Artificial Sequence
  Description of Artificial Sequence: Synthetic peptide
LPETG

SEQ ID NO: 225 - DNA, 36 bp, Artificial Sequence
  Description of Artificial Sequence: Synthetic oligonucleotide
aggtgaatctccdggtggytcyagcggttcygartc

SEQ ID NO: 226 - DNA, 36 bp, Artificial Sequence
  Description of Artificial Sequence: Synthetic oligonucleotide
acctgaytcrgaaccgctrgarccacchggagattc

SEQ ID NO: 227 - DNA, 36 bp, Artificial Sequence
  Description of Artificial Sequence: Synthetic oligonucleotide
aggtagcgaaggttcttcyggtccdggygartcytc

SEQ ID NO: 228 - DNA, 36 bp, Artificial Sequence
  Description of Artificial Sequence: Synthetic oligonucleotide
acctgargaytcrcchggaccrgaagaaccttcgct

SEQ ID NO: 229 - DNA, 36 bp, Artificial Sequence
  Description of Artificial Sequence: Synthetic oligonucleotide
aggttcytcygaaagcggttcttcygarggyggtcc

SEQ ID NO: 230 - DNA, 36 bp, Artificial Sequence
  Description of Artificial Sequence: Synthetic oligonucleotide
acctggaccrccytcrgaagaaccgctttcrgarga

SEQ ID NO: 231 - DNA, 36 bp, Artificial Sequence
  Description of Artificial Sequence: Synthetic oligonucleotide
aggttcyggtggygaaccdtcygartctggtagctc

SEQ ID NO: 232 - DNA, 24 bp, Artificial Sequence
  Description of Artificial Sequence: Synthetic oligonucleotide
aggttcgtcttcactcgagggtac

SEQ ID NO: 233 - DNA, 16 bp, Artificial Sequence
  Description of Artificial Sequence: Synthetic oligonucleotide
cctcgagtgaagacga

SEQ ID NO: 234 - protein, 36 aa, Artificial Sequence
  Description of Artificial Sequence: Synthetic polypeptide
GSGGEPSESGSSGESPGGSSGSESGESPGGSSGSES

SEQ ID NO: 235 - protein, 36 aa, Artificial Sequence
  Description of Artificial Sequence: Synthetic polypeptide
GSEGSSGPGESSGESPGGSSGSESGSSESGSSEGGP

SEQ ID NO: 236 - protein, 36 aa, Artificial Sequence
  Description of Artificial Sequence: Synthetic polypeptide
GSSESGSSEGGPGSSESGSSEGGPGESPGGSSGSES

SEQ ID NO: 237 - protein, 36 aa, Artificial Sequence
  Description of Artificial Sequence: Synthetic polypeptide
GSGGEPSESGSSGSSESGSSEGGPGSGGEPSESGSS

SEQ ID NO: 238 - protein, 36 aa, Artificial Sequence
  Description of Artificial Sequence: Synthetic polypeptide
GSSESGSSEGGPGSEGSSGPGESSGSEGSSGPGESS

SEQ ID NO: 239 - protein, 36 aa, Artificial Sequence
  Description of Artificial Sequence: Synthetic polypeptide
GSSESGSSEGGPGESPGGSSGSESGSEGSSGPGESS

SEQ ID NO: 240 - protein, 36 aa, Artificial Sequence
  Description of Artificial Sequence: Synthetic polypeptide
GSGGEPSESGSSGSGGEPSESGSSGSEGSSGPGESS

SEQ ID NO: 241 - protein, 36 aa, Artificial Sequence
  Description of Artificial Sequence: Synthetic polypeptide
GSSESGSSEGGPGSEGSSGPGESSGESPGGSSGSES

SEQ ID NO: 242 - protein, 36 aa, Artificial Sequence
  Description of Artificial Sequence: Synthetic polypeptide
GSSESGSSEGGPGSSESGSSEGGPGSSESGSSEGGP

SEQ ID NO: 243 - protein, 36 aa, Artificial Sequence
  Description of Artificial Sequence: Synthetic polypeptide
GSGGEPSESGSSGSEGSSGPGESSGSSESGSSEGGP

SEQ ID NO: 244 - protein, 36 aa, Artificial Sequence; identical to SEQ ID NO: 237
  Description of Artificial Sequence: Synthetic polypeptide

SEQ ID NO: 245 - protein, 36 aa, Artificial Sequence
  Description of Artificial Sequence: Synthetic polypeptide
GSGGEPSESGSSGSSESGSSEGGPGESPGGSSGSES

SEQ ID NO: 246 - protein, 36 aa, Artificial Sequence
  Description of Artificial Sequence: Synthetic polypeptide
GSGGEPSESGSSGESPGGSSGSESGSEGSSGPGESS

SEQ ID NO: 247 - protein, 36 aa, Artificial Sequence
  Description of Artificial Sequence: Synthetic polypeptide
GSGGEPSESGSSGESPGGSSGSESGSGGEPSESGSS

SEQ ID NO: 248 - protein, 36 aa, Artificial Sequence; identical to SEQ ID NO: 242
  Description of Artificial Sequence: Synthetic polypeptide

SEQ ID NO: 249 - protein, 36 aa, Artificial Sequence
  Description of Artificial Sequence: Synthetic polypeptide
GESPGGSSGSESGSEGSSGPGESSGSEGSSGPGESS

SEQ ID NO: 250 - protein, 36 aa, Artificial Sequence
  Description of Artificial Sequence: Synthetic polypeptide
GSGGEPSESGSSGSGGEPSESGSSGSSESGSSEGGP

SEQ ID NO: 251 - protein, 36 aa, Artificial Sequence
  Description of Artificial Sequence: Synthetic polypeptide
GSGGEPSESGSSGSGGEPSESGSSGSGGEPSESGSS

SEQ ID NO: 252 - protein, 36 aa, Artificial Sequence
  Description of Artificial Sequence: Synthetic polypeptide
GSGGEPSESGSSGSSESGSSEGGPGSEGSSGPGESS

SEQ ID NO: 253 - protein, 36 aa, Artificial Sequence
  Description of Artificial Sequence: Synthetic polypeptide
GSGGEPSESGSSGSEGSSGPGESSGSGGEPSESGSS

SEQ ID NO: 254 - protein, 36 aa, Artificial Sequence; identical to SEQ ID NO: 247
  Description of Artificial Sequence: Synthetic polypeptide

SEQ ID NO: 255 - protein, 36 aa, Artificial Sequence
  Description of Artificial Sequence: Synthetic polypeptide
GSSESGSSEGGPGSGGEPSESGSSGSSESGSSEGGP

SEQ ID NO: 256 - protein, 36 aa, Artificial Sequence
  Description of Artificial Sequence: Synthetic polypeptide
GSEGSSGPGESSGESPGGSSGSESGSEGSSGPGESS

SEQ ID NO: 257 - protein, 36 aa, Artificial Sequence; identical to SEQ ID NO: 242
  Description of Artificial Sequence: Synthetic polypeptide

SEQ ID NO: 258 - protein, 36 aa, Artificial Sequence; identical to SEQ ID NO: 234
  Description of Artificial Sequence: Synthetic polypeptide

SEQ ID NO: 259 - protein, 36 aa, Artificial Sequence
  Description of Artificial Sequence: Synthetic polypeptide
GSGGEPSESGSSGSEGSSGPGESSGESPGGSSGSES

SEQ ID NO: 260 - protein, 36 aa, Artificial Sequence
  Description of Artificial Sequence: Synthetic polypeptide
GESPGGSSGSESGESPGGSSGSESGESPGGSSGSES

SEQ ID NO: 261 - protein, 36 aa, Artificial Sequence
  Description of Artificial Sequence: Synthetic polypeptide
GSEGSSGPGESSGSEGSSGPGESSGSGGEPSESGSS

SEQ ID NO: 262 - protein, 36 aa, Artificial Sequence; identical to SEQ ID NO: 259
  Description of Artificial Sequence: Synthetic polypeptide

SEQ ID NO: 263 - protein, 36 aa, Artificial Sequence; identical to SEQ ID NO: 237
  Description of Artificial Sequence: Synthetic polypeptide

SEQ ID NO: 264 - protein, 36 aa, Artificial Sequence
  Description of Artificial Sequence: Synthetic polypeptide
GSSESGSSEGGPGSGGEPSESGSSGSEGSSGPGESS

SEQ ID NO: 265 - protein, 36 aa, Artificial Sequence
  Description of Artificial Sequence: Synthetic polypeptide
GSGGEPSESGSSGSEGSSGPGESSGSEGSSGPGESS

SEQ ID NO: 266 - protein, 36 aa, Artificial Sequence; identical to SEQ ID NO: 237
  Description of Artificial Sequence: Synthetic polypeptide

SEQ ID NO: 267 - protein, 36 aa, Artificial Sequence; identical to SEQ ID NO: 234
  Description of Artificial Sequence: Synthetic polypeptide

SEQ ID NO: 268 - protein, 36 aa, Artificial Sequence
  Description of Artificial Sequence: Synthetic polypeptide
GSGGEPSESGSSGSGGEPSESGSSGESPGGSSGSES

SEQ ID NO: 269 - protein, 36 aa, Artificial Sequence
  Description of Artificial Sequence: Synthetic polypeptide
GSEGSSGPGESSGSSESGSSEGGPGSEGSSGPGESS

SEQ ID NO: 270 - protein, 36 aa, Artificial Sequence
  Description of Artificial Sequence: Synthetic polypeptide
GSSESGSSEGGPGESPGGSSGSESGESPGGSSGSES

SEQ ID NO: 271 - protein, 36 aa, Artificial Sequence; identical to SEQ ID NO: 261
  Description of Artificial Sequence: Synthetic polypeptide

SEQ ID NO: 272 - DNA, 108 bp, Artificial Sequence
  Description of Artificial Sequence: Synthetic polynucleotide
ggttctggtggcgaaccgtccgagtctggtagctcaggtgaatctccgggtggctctagcggttccgagtcaggtgaatctcctggtggttccagcggttccgagtca

SEQ ID NO: 273 - DNA, 108 bp, Artificial Sequence
  Description of Artificial Sequence: Synthetic polynucleotide
ggtagcgaaggttcttctggtcctggcgagtcttcaggtgaatctcctggtggttccagcggttctgaatcaggttcctccgaaagcggttcttccgagggcggtcca

SEQ ID NO: 274 - DNA, 108 bp, Artificial Sequence
  Description of Artificial Sequence: Synthetic polynucleotide
ggttcctctgaaagcggttcttccgaaggtggtccaggttcctctgaaagcggttcttctgagggtggtccaggtgaatctccgggtggctccagcggttccgagtca

SEQ ID NO: 275 - DNA, 108 bp, Artificial Sequence
  Description of Artificial Sequence: Synthetic polynucleotide
ggttccggtggcgaaccgtctgaatctggtagctcaggttcttctgaaagcggttcttccgagggtggtccaggttctggtggtgaaccttccgagtctggtagctca

SEQ ID NO: 276 - DNA, 108 bp, Artificial Sequence
  Description of Artificial Sequence: Synthetic polynucleotide
ggttcttccgaaagcggttcttctgagggtggtccaggtagcgaaggttcttccggtccaggtgagtcttcaggtagcgaaggttcttctggtcctggtgaatcttca

SEQ ID NO: 277 - DNA, 108 bp, Artificial Sequence
  Description of Artificial Sequence: Synthetic polynucleotide
ggttcctctgaaagcggttcttccgagggtggtccaggtgaatctccaggtggttccagcggttctgagtcaggtagcgaaggttcttctggtccaggtgaatcctca

SEQ ID NO: 278 - DNA, 108 bp, Artificial Sequence
  Description of Artificial Sequence: Synthetic polynucleotide
ggttctggtggtgaaccgtctgagtctggtagctcaggttccggtggcgaaccatccgaatctggtagctcaggtagcgaaggttcttccggtccaggtgagtcttca

SEQ ID NO: 279 - DNA, 108 bp, Artificial Sequence
  Description of Artificial Sequence: Synthetic polynucleotide
ggttcttccgaaagcggttcttccgaaggcggtccaggtagcgaaggttcttctggtccaggcgaatcttcaggtgaatctcctggtggctccagcggttctgagtca

SEQ ID NO: 280 - DNA, 108 bp, Artificial Sequence
  Description of Artificial Sequence: Synthetic polynucleotide
ggttcctccgaaagcggttcttctgagggcggtccaggttcctccgaaagcggttcttccgagggcggtccaggttcttctgaaagcggttcttccgagggcggtcca

SEQ ID NO: 281 - DNA, 108 bp, Artificial Sequence
  Description of Artificial Sequence: Synthetic polynucleotide
ggttccggtggcgaaccgtccgaatctggtagctcaggtagcgaaggttcttctggtccaggcgaatcttcaggttcctctgaaagcggttcttctgagggcggtcca

SEQ ID NO: 282 - DNA, 108 bp, Artificial Sequence
  Description of Artificial Sequence: Synthetic polynucleotide
ggttctggtggtgaaccgtccgaatctggtagctcaggttcttccgaaagcggttcttctgaaggtggtccaggttccggtggcgaaccttctgaatctggtagctca

SEQ ID NO: 283 - DNA, 108 bp, Artificial Sequence
  Description of Artificial Sequence: Synthetic polynucleotide
ggttctggtggcgaaccgtccgaatctggtagctcaggttcctccgaaagcggttcttctgaaggtggtccaggtgaatctccaggtggttctagcggttctgaatca

SEQ ID NO: 284 - DNA, 108 bp, Artificial Sequence
  Description of Artificial Sequence: Synthetic polynucleotide
ggttctggtggcgaaccgtctgagtctggtagctcaggtgaatctcctggtggctccagcggttctgaatcaggtagcgaaggttcttctggtcctggtgaatcttca

SEQ ID NO: 285 - DNA, 108 bp, Artificial Sequence
  Description of Artificial Sequence: Synthetic polynucleotide
ggttccggtggcgaaccttccgaatctggtagctcaggtgaatctccgggtggttctagcggttctgagtcaggttctggtggtgaaccttccgagtctggtagctca

SEQ ID NO: 286 - DNA, 108 bp, Artificial Sequence
  Description of Artificial Sequence: Synthetic polynucleotide
ggttcctctgaaagcggttcttctgagggcggtccaggttcttccgaaagcggttcttccgagggcggtccaggttcttccgaaagcggttcttctgaaggcggtcca

SEQ ID NO: 287 - DNA, 108 bp, Artificial Sequence
  Description of Artificial Sequence: Synthetic polynucleotide
ggtgaatctccgggtggctccagcggttctgagtcaggtagcgaaggttcttccggtccgggtgagtcctcaggtagcgaaggttcttccggtcctggtgagtcttca

SEQ ID NO: 288 - DNA, 108 bp, Artificial Sequence
  Description of Artificial Sequence: Synthetic polynucleotide
ggttctggtggcgaaccttccgaatctggtagctcaggttccggtggtgaaccttctgaatctggtagctcaggttcttctgaaagcggttcttccgagggcggtcca

SEQ ID NO: 289 - DNA, 108 bp, Artificial Sequence
  Description of Artificial Sequence: Synthetic polynucleotide
ggttccggtggtgaaccttctgaatctggtagctcaggttccggtggcgaaccatccgagtctggtagctcaggttccggtggtgaaccatccgagtctggtagctca

SEQ ID NO: 290 - DNA, 108 bp, Artificial Sequence
  Description of Artificial Sequence: Synthetic polynucleotide
ggttccggtggcgaaccttctgaatctggtagctcaggttcctccgaaagcggttcttctgagggcggtccaggtagcgaaggttcttctggtccgggcgagtcttca

SEQ ID NO: 291 - DNA, 108 bp, Artificial Sequence
  Description of Artificial Sequence: Synthetic polynucleotide
ggttccggtggtgaaccgtccgagtctggtagctcaggtagcgaaggttcttctggtccgggtgagtcttcaggttctggtggcgaaccgtccgaatctggtagctca

SEQ ID NO: 292 - DNA, 108 bp, Artificial Sequence
  Description of Artificial Sequence: Synthetic polynucleotide
ggttctggtggcgaaccgtccgaatctggtagctcaggtgaatctcctggtggttccagcggttccgagtcaggttctggtggcgaaccttccgaatctggtagctca

SEQ ID NO: 293 - DNA, 108 bp, Artificial Sequence
  Description of Artificial Sequence: Synthetic polynucleotide
ggttcttccgaaagcggttcttccgagggcggtccaggttccggtggtgaaccatctgaatctggtagctcaggttcttctgaaagcggttcttctgaaggtggtcca

SEQ ID NO: 294 - DNA, 108 bp, Artificial Sequence
  Description of Artificial Sequence: Synthetic polynucleotide
ggtagcgaaggttcttccggtcctggtgagtcttcaggtgaatctccaggtggctctagcggttccgagtcaggtagcgaaggttcttctggtcctggcgagtcctca

SEQ ID NO: 295 - DNA, 108 bp, Artificial Sequence
  Description of Artificial Sequence: Synthetic polynucleotide
ggttcctctgaaagcggttcttccgaaggcggtccaggttcttccgaaagcggttcttctgagggcggtccaggttcctccgaaagcggttcttctgagggtggtcca

SEQ ID NO: 296 - DNA, 108 bp, Artificial Sequence
  Description of Artificial Sequence: Synthetic polynucleotide
ggttctggtggcgaaccttccgagtctggtagctcaggtgaatctccgggtggttctagcggttccgagtcaggtgaatctccgggtggttccagcggttctgagtca

SEQ ID NO: 297 - DNA, 108 bp, Artificial Sequence
  Description of Artificial Sequence: Synthetic polynucleotide
ggttctggtggcgaaccatctgagtctggtagctcaggtagcgaaggttcttccggtccaggcgagtcttcaggtgaatctcctggtggctccagcggttctgagtca

SEQ ID NO: 298 - DNA, 108 bp, Artificial Sequence
  Description of Artificial Sequence: Synthetic polynucleotide
ggtgaatctcctggtggttccagcggttccgagtcaggtgaatctccaggtggctctagcggttccgagtcaggtgaatctcctggtggttctagcggttctgaatca

SEQ ID NO: 299 - DNA, 108 bp, Artificial Sequence
  Description of Artificial Sequence: Synthetic polynucleotide
ggtagcgaaggttcttccggtccaggtgaatcttcaggtagcgaaggttcttctggtcctggtgaatcctcaggttccggtggcgaaccatctgaatctggtagctca

SEQ ID NO: 300 - DNA, 108 bp, Artificial Sequence
  Description of Artificial Sequence: Synthetic polynucleotide
ggttctggtggcgaaccatccgaatctggtagctcaggtagcgaaggttcttctggtcctggcgaatcttcaggtgaatctccaggtggctctagcggttccgaatca

SEQ ID NO: 301 - DNA, 108 bp, Artificial Sequence
  Description of Artificial Sequence: Synthetic polynucleotide
ggttccggtggtgaaccgtccgaatctggtagctcaggttcctctgaaagcggttcttccgagggtggtccaggttccggtggtgaaccttctgagtctggtagctca

SEQ ID NO: 302 - DNA, 108 bp, Artificial Sequence
  Description of Artificial Sequence: Synthetic polynucleotide
ggttcctctgaaagcggttcttctgagggcggtccaggttctggtggcgaaccatctgaatctggtagctcaggtagcgaaggttcttccggtccgggtgaatcttca

SEQ ID NO: 303 - DNA, 108 bp, Artificial Sequence
  Description of Artificial Sequence: Synthetic polynucleotide
ggttctggtggtgaaccgtccgaatctggtagctcaggtagcgaaggttcttctggtcctggcgagtcttcaggtagcgaaggttcttctggtcctggtgaatcttca

SEQ ID NO: 304 - DNA, 108 bp, Artificial Sequence
  Description of Artificial Sequence: Synthetic polynucleotide
ggttctggtggcgaaccatccgagtctggtagctcaggttcttccgaaagcggttcttccgaaggcggtccaggttctggtggtgaaccgtccgaatctggtagctca

SEQ ID NO: 305 - DNA, 108 bp, Artificial Sequence
  Description of Artificial Sequence: Synthetic polynucleotide
ggttccggtggcgaaccttccgaatctggtagctcaggtgaatctccgggtggttctagcggttccgaatcaggtgaatctccaggtggttctagcggttccgaatca

SEQ ID NO: 306 - DNA, 108 bp, Artificial Sequence
  Description of Artificial Sequence: Synthetic polynucleotide
ggttccggtggtgaaccatctgagtctggtagctcaggttccggtggcgaaccgtccgagtctggtagctcaggtgaatctccgggtggttccagcggttccgaatca

SEQ ID NO: 307 - DNA, 108 bp, Artificial Sequence
  Description of Artificial Sequence: Synthetic polynucleotide
ggtagcgaaggttcttctggtccgggcgaatcctcaggttcctccgaaagcggttcttccgaaggtggtccaggtagcgaaggttcttccggtcctggtgaatcttca

SEQ ID NO: 308 - DNA, 108 bp, Artificial Sequence
  Description of Artificial Sequence: Synthetic polynucleotide
ggttcctctgaaagcggttcttctgaaggcggtccaggtgaatctccgggtggctccagcggttctgaatcaggtgaatctcctggtggctccagcggttccgagtca

SEQ ID NO: 309 - DNA, 108 bp, Artificial Sequence
  Description of Artificial Sequence: Synthetic polynucleotide
ggtagcgaaggttcttctggtccaggcgagtcttcaggtagcgaaggttcttccggtcctggcgagtcttcaggttccggtggcgaaccgtccgaatctggtagctca

SEQ ID NO: 310 - DNA, 36 bp, Artificial Sequence
  Description of Artificial Sequence: Synthetic oligonucleotide
aggtagcccdgcwggytctccdacytcyacygarga

SEQ ID NO: 311 - DNA, 36 bp, Artificial Sequence
  Description of Artificial Sequence: Synthetic oligonucleotide
accttcytcrgtrgargthggagarccwgchgggct

SEQ ID NO: 312 - DNA, 36 bp, Artificial Sequence
  Description of Artificial Sequence: Synthetic oligonucleotide
aggtagcgaacckgcwacytcyggytctgaracycc

SEQ ID NO: 313 - DNA, 36 bp, Artificial Sequence
  Description of Artificial Sequence: Synthetic oligonucleotide
acctggrgtytcagarccrgargtwgcmggttcgct

SEQ ID NO: 314 - DNA, 36 bp, Artificial Sequence
  Description of Artificial Sequence: Synthetic oligonucleotide
aggtacytctgaaagcgcwacycckgartcyggycc

SEQ ID NO: 315 - DNA, 36 bp, Artificial Sequence
  Description of Artificial Sequence: Synthetic oligonucleotide
acctggrccrgaytcmggrgtwgcgctttcagargt

SEQ ID NO: 316 - DNA, 36 bp, Artificial Sequence
  Description of Artificial Sequence: Synthetic oligonucleotide
aggtacytctacygaaccktcygarggyagcgcwcc

SEQ ID NO: 317 - DNA, 36 bp, Artificial Sequence
  Description of Artificial Sequence: Synthetic oligonucleotide
acctggwgcgctrccytcrgamggttcrgtagargt

SEQ ID NO: 318 - protein, 36 aa, Artificial Sequence
  Description of Artificial Sequence: Synthetic polypeptide
GSPAGSPTSTEEGTSESATPESGPGTSTEPSEGSAP

SEQ ID NO: 319 - protein, 36 aa, Artificial Sequence
  Description of Artificial Sequence: Synthetic polypeptide
GTSTEPSEGSAPGTSTEPSEGSAPGTSTEPSEGSAP

SEQ ID NO: 320 - protein, 36 aa, Artificial Sequence
  Description of Artificial Sequence: Synthetic polypeptide
GTSTEPSEGSAPGTSESATPESGPGTSESATPESGP

SEQ ID NO: 321 - protein, 36 aa, Artificial Sequence; identical to SEQ ID NO: 320
  Description of Artificial Sequence: Synthetic polypeptide

SEQ ID NO: 322 - protein, 36 aa, Artificial Sequence
  Description of Artificial Sequence: Synthetic polypeptide
GSEPATSGSETPGTSESATPESGPGSPAGSPTSTEE

SEQ ID NO: 323 - protein, 36 aa, Artificial Sequence
  Description of Artificial Sequence: Synthetic polypeptide
GTSESATPESGPGSEPATSGSETPGTSTEPSEGSAP

SEQ ID NO: 324 - protein, 36 aa, Artificial Sequence
  Description of Artificial Sequence: Synthetic polypeptide
GSPAGSPTSTEEGSPAGSPTSTEEGSEPATSGSETP

SEQ ID NO: 325 - protein, 36 aa, Artificial Sequence; identical to SEQ ID NO: 318
  Description of Artificial Sequence: Synthetic polypeptide

SEQ ID NO: 326 - protein, 36 aa, Artificial Sequence
  Description of Artificial Sequence: Synthetic polypeptide
GSPAGSPTSTEEGSPAGSPTSTEEGTSTEPSEGSAP

SEQ ID NO: 327 - protein, 36 aa, Artificial Sequence
  Description of Artificial Sequence: Synthetic polypeptide
GTSESATPESGPGTSTEPSEGSAPGTSTEPSEGSAP

SEQ ID NO: 328 - protein, 36 aa, Artificial Sequence
  Description of Artificial Sequence: Synthetic polypeptide
GTSTEPSEGSAPGSPAGSPTSTEEGTSTEPSEGSAP

SEQ ID NO: 329 - protein, 36 aa, Artificial Sequence
  Description of Artificial Sequence: Synthetic polypeptide
GSEPATSGSETPGSPAGSPTSTEEGTSESATPESGP

SEQ ID NO: 330 - protein, 36 aa, Artificial Sequence; identical to SEQ ID NO: 320
  Description of Artificial Sequence: Synthetic polypeptide

SEQ ID NO: 331 - protein, 36 aa, Artificial Sequence
  Description of Artificial Sequence: Synthetic polypeptide
GTSTEPSEGSAPGSEPATSGSETPGSPAGSPTSTEE

SEQ ID NO: 332 - protein, 36 aa, Artificial Sequence
  Description of Artificial Sequence: Synthetic polypeptide
GSPAGSPTSTEEGTSESATPESGPGSEPATSGSETP

SEQ ID NO: 333 - protein, 36 aa, Artificial Sequence
  Description of Artificial Sequence: Synthetic polypeptide
GTSESATPESGPGSPAGSPTSTEEGSPAGSPTSTEE

SEQ ID NO: 334 - protein, 36 aa, Artificial Sequence
  Description of Artificial Sequence: Synthetic polypeptide
GTSTEPSEGSAPGTSESATPESGPGTSTEPSEGSAP

SEQ ID NO: 335 - protein, 36 aa, Artificial Sequence
  Description of Artificial Sequence: Synthetic polypeptide
GSPAGSPTSTEEGTSTEPSEGSAPGSEPATSGSETP

SEQ ID NO: 336 - protein, 36 aa, Artificial Sequence
  Description of Artificial Sequence: Synthetic polypeptide
GSPAGSPTSTEEGTSTEPSEGSAPGTSTEPSEGSAP

SEQ ID NO: 337 - protein, 36 aa, Artificial Sequence; identical to SEQ ID NO: 322
  Description of Artificial Sequence: Synthetic polypeptide

SEQ ID NO: 338 - protein, 36 aa, Artificial Sequence; identical to SEQ ID NO: 327
  Description of Artificial Sequence: Synthetic polypeptide

SEQ ID NO: 339 - protein, 36 aa, Artificial Sequence; identical to SEQ ID NO: 336
  Description of Artificial Sequence: Synthetic polypeptide

SEQ ID NO: 340 - protein, 36 aa, Artificial Sequence; identical to SEQ ID NO: 319
  Description of Artificial Sequence: Synthetic polypeptide

SEQ ID NO: 341 - protein, 36 aa, Artificial Sequence
  Description of Artificial Sequence: Synthetic polypeptide
GSEPATSGSETPGTSESATPESGPGTSTEPSEGSAP

SEQ ID NO: 342 - protein, 36 aa, Artificial Sequence; identical to SEQ ID NO: 328
  Description of Artificial Sequence: Synthetic polypeptide

SEQ ID NO: 343 - protein, 36 aa, Artificial Sequence
  Description of Artificial Sequence: Synthetic polypeptide
GSEPATSGSETPGTSESATPESGPGSEPATSGSETP

SEQ ID NO: 344 - protein, 36 aa, Artificial Sequence; identical to SEQ ID NO: 343
  Description of Artificial Sequence: Synthetic polypeptide

SEQ ID NO: 345 - protein, 36 aa, Artificial Sequence
  Description of Artificial Sequence: Synthetic polypeptide
GSEPATSGSETPGSEPATSGSETPGTSTEPSEGSAP

SEQ ID NO: 346 - protein, 36 aa, Artificial Sequence
  Description of Artificial Sequence: Synthetic polypeptide
GTSESATPESGPGSEPATSGSETPGSEPATSGSETP

SEQ ID NO: 347 - protein, 36 aa, Artificial Sequence
  Description of Artificial Sequence: Synthetic polypeptide
GTSTEPSEGSAPGTSTEPSEGSAPGTSESATPESGP

SEQ ID NO: 348 - protein, 36 aa, Artificial Sequence
  Description of Artificial Sequence: Synthetic polypeptide
GSEPATSGSETPGTSESATPESGPGTSESATPESGP

SEQ ID NO: 349 - protein, 36 aa, Artificial Sequence; identical to SEQ ID NO: 345
  Description of Artificial Sequence: Synthetic polypeptide

SEQ ID NO: 350 - protein, 36 aa, Artificial Sequence
  Description of Artificial Sequence: Synthetic polypeptide
GSEPATSGSETPGTSTEPSEGSAPGSEPATSGSETP

SEQ ID NO: 351 - protein, 36 aa, Artificial Sequence
  Description of Artificial Sequence: Synthetic polypeptide
GTSTEPSEGSAPGTSTEPSEGSAPGSEPATSGSETP

SEQ ID NO: 352 - protein, 36 aa, Artificial Sequence; identical to SEQ ID NO: 331
  Description of Artificial Sequence: Synthetic polypeptide

SEQ ID NO: 353 - protein, 36 aa, Artificial Sequence; identical to SEQ ID NO: 329
  Description of Artificial Sequence: Synthetic polypeptide

SEQ ID NO: 354 - protein, 36 aa, Artificial Sequence
  Description of Artificial Sequence: Synthetic polypeptide
GTSESATPESGPGSEPATSGSETPGTSESATPESGP

SEQ ID NO: 355 - DNA, 108 bp, Artificial Sequence
  Description of Artificial Sequence: Synthetic polynucleotide
ggtagcccggcaggctctccgacctctactgaggaaggtacttctgaaagcgcaaccccggagtccggcccaggtacctctaccgaaccgtctgagggcagcgcacca

SEQ ID NO: 356 - DNA, 108 bp, Artificial Sequence
  Description of Artificial Sequence: Synthetic polynucleotide
ggtacttctaccgaaccgtccgaaggcagcgctccaggtacctctactgaaccttccgagggcagcgctccaggtacctctaccgaaccttctgaaggtagcgcacca

SEQ ID NO: 357 - DNA, 108 bp, Artificial Sequence
  Description of Artificial Sequence: Synthetic polynucleotide
ggtacctctaccgaaccgtctgaaggtagcgcaccaggtacctctgaaagcgcaactcctgagtccggtccaggtacttctgaaagcgcaaccccggagtctggccca

SEQ ID NO: 358 - DNA, 108 bp, Artificial Sequence
  Description of Artificial Sequence: Synthetic polynucleotide
ggtacttctactgaaccgtctgaaggtagcgcaccaggtacttctgaaagcgcaaccccggaatccggcccaggtacctctgaaagcgcaaccccggagtccggccca

SEQ ID NO: 359 - DNA, 108 bp, Artificial Sequence
  Description of Artificial Sequence: Synthetic polynucleotide
ggtagcgaaccggcaacctccggctctgaaaccccaggtacctctgaaagcgctactcctgaatccggcccaggtagcccggcaggttctccgacttccactgaggaa

SEQ ID NO: 360 - DNA, 108 bp, Artificial Sequence
  Description of Artificial Sequence: Synthetic polynucleotide
ggtacttctgaaagcgcaacccctgaatccggtccaggtagcgaaccggctacttctggctctgagactccaggtacttctaccgaaccgtccgaaggtagcgcacca

SEQ ID NO: 361 - DNA, 108 bp, Artificial Sequence
  Description of Artificial Sequence: Synthetic polynucleotide
ggtagcccggctggctctccaacctccactgaggaaggtagcccggctggctctccaacctccactgaagaaggtagcgaaccggctacctccggctctgaaactcca

SEQ ID NO: 362 - DNA, 108 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctcca

SEQ ID NO: 363 - DNA, 108 bp, Artificial Sequence
  Description of Artificial Sequence: Synthetic polynucleotide
ggtagccctgctggctctccgacttctactgaggaaggtagcccggctggttctccgacttctactgaggaaggtacttctaccgaaccttccgaaggtagcgctcca

SEQ ID NO: 364 - DNA, 108 bp, Artificial Sequence
  Description of Artificial Sequence: Synthetic polynucleotide
ggtacttctgaaagcgctactccggagtccggtccaggtacctctaccgaaccgtccgaaggcagcgctccaggtacttctactgaaccttctgagggtagcgctcca

SEQ ID NO: 365 - DNA, 108 bp, Artificial Sequence
  Description of Artificial Sequence: Synthetic polynucleotide
ggtacctctaccgaaccttccgaaggtagcgctccaggtagcccggcaggttctcctacttccactgaggaaggtacttctaccgaaccttctgagggtagcgcacca

SEQ ID NO: 366 - DNA, 108 bp, Artificial Sequence
  Description of Artificial Sequence: Synthetic polynucleotide
ggtagcgaaccggctacttccggctctgagactccaggtagccctgctggctctccgacctctaccgaagaaggtacctctgaaagcgctacccctgagtctggccca

SEQ ID NO: 367 - DNA, 108 bp, Artificial Sequence
  Description of Artificial Sequence: Synthetic polynucleotide
ggtacttctaccgaaccttccgagggcagcgcaccaggtacttctgaaagcgctacccctgagtccggcccaggtacttctgaaagcgctactcctgaatccggtcca

SEQ ID NO: 368 - DNA, 108 bp, Artificial Sequence
  Description of Artificial Sequence: Synthetic polynucleotide
ggtacttctactgaaccgtctgaaggcagcgcaccaggtagcgaaccggctacttccggttctgaaaccccaggtagcccagcaggttctccaacttctactgaagaa

SEQ ID NO: 369 - DNA, 108 bp, Artificial Sequence
  Description of Artificial Sequence: Synthetic polynucleotide
ggtagccctgctggctctccaacctccaccgaagaaggtacctctgaaagcgcaacccctgaatccggcccaggtagcgaaccggcaacctccggttctgaaacccca

SEQ ID NO: 370 - DNA, 108 bp, Artificial Sequence
  Description of Artificial Sequence: Synthetic polynucleotide
ggtacttctgaaagcgctactcctgagtccggcccaggtagcccggctggctctccgacttccaccgaggaaggtagcccggctggctctccaacttctactgaagaa

SEQ ID NO: 371 - DNA, 108 bp, Artificial Sequence
  Description of Artificial Sequence: Synthetic polynucleotide
ggtacctctactgaaccttctgagggcagcgctccaggtacttctgaaagcgctaccccggagtccggtccaggtacttctactgaaccgtccgaaggtagcgcacca

SEQ ID NO: 372 - DNA, 108 bp, Artificial Sequence
  Description of Artificial Sequence: Synthetic polynucleotide
ggtagcccggcaggctctccgacttccaccgaggaaggtacctctactgaaccttctgagggtagcgctccaggtagcgaaccggcaacctctggctctgaaacccca

SEQ ID NO: 373 - DNA, 108 bp, Artificial Sequence
  Description of Artificial Sequence: Synthetic polynucleotide
ggtagcccagcaggctctccgacttccactgaggaaggtacttctactgaaccttccgaaggcagcgcaccaggtacctctactgaaccttctgagggcagcgctcca

SEQ ID NO: 374 - DNA, 108 bp, Artificial Sequence
  Description of Artificial Sequence: Synthetic polynucleotide
ggtagcgaacctgctacctccggttctgaaaccccaggtacctctgaaagcgcaactccggagtctggtccaggtagccctgcaggttctcctacctccactgaggaa

SEQ ID NO: 375 - DNA, 108 bp, Artificial Sequence
  Description of Artificial Sequence: Synthetic polynucleotide
ggtacctctgaaagcgctactccggagtctggcccaggtacctctactgaaccgtctgagggtagcgctccaggtacttctactgaaccgtccgaaggtagcgcacca

SEQ ID NO: 376 - DNA, 108 bp, Artificial Sequence
  Description of Artificial Sequence: Synthetic polynucleotide
ggtagcccggctggttctccgacttccaccgaggaaggtacctctactgaaccttctgagggtagcgctccaggtacctctactgaaccttccgaaggcagcgctcca

SEQ ID NO: 377 - DNA, 108 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcacca

SEQ ID NO: 378 - DNA, 108 bp, Artificial Sequence
  Description of Artificial Sequence: Synthetic polynucleotide
ggtagcgaacctgcaacctctggctctgaaaccccaggtacctctgaaagcgctactcctgaatctggcccaggtacttctactgaaccgtccgagggcagcgcacca

SEQ ID NO: 379 - DNA, 108 bp, Artificial Sequence
  Description of Artificial Sequence: Synthetic polynucleotide
ggtacttctaccgaaccgtccgagggtagcgcaccaggtagcccagcaggttctcctacctccaccgaggaaggtacttctaccgaaccgtccgagggtagcgcacca

SEQ ID NO: 380 - DNA, 108 bp, Artificial Sequence
  Description of Artificial Sequence: Synthetic polynucleotide
ggtagcgaaccggcaacctccggctctgaaactccaggtacttctgaaagcgctactccggaatccggcccaggtagcgaaccggctacttccggctctgaaacccca

SEQ ID NO: 381 - DNA, 108 bp, Artificial Sequence
  Description of Artificial Sequence: Synthetic polynucleotide
ggtagcgaaccggcaacttccggctctgaaaccccaggtacttctgaaagcgctactcctgagtctggcccaggtagcgaacctgctacctctggctctgaaacccca

SEQ ID NO: 382 - DNA, 108 bp, Artificial Sequence
  Description of Artificial Sequence: Synthetic polynucleotide
ggtagcgaaccggcaacctctggctctgaaactccaggtagcgaacctgcaacctccggctctgaaaccccaggtacttctactgaaccttctgagggcagcgcacca

SEQ ID NO: 383 - DNA, 108 bp, Artificial Sequence
  Description of Artificial Sequence: Synthetic polynucleotide
ggtacttctgaaagcgctaccccggaatctggcccaggtagcgaaccggctacttctggttctgaaaccccaggtagcgaaccggctacctccggttctgaaactcca

SEQ ID NO: 384 - DNA, 108 bp, Artificial Sequence
  Description of Artificial Sequence: Synthetic polynucleotide
ggtacctctactgaaccttccgaaggcagcgctccaggtacctctaccgaaccgtccgagggcagcgcaccaggtacttctgaaagcgcaacccctgaatccggtcca

SEQ ID NO: 385 - DNA, 108 bp, Artificial Sequence
  Description of Artificial Sequence: Synthetic polynucleotide
ggtagcgaaccggcaacctctggctctgaaaccccaggtacctctgaaagcgctactccggaatctggtccaggtacttctgaaagcgctactccggaatccggtcca

SEQ ID NO: 386 - DNA, 108 bp, Artificial Sequence
  Description of Artificial Sequence: Synthetic polynucleotide
ggtagcgaacctgctacctccggctctgaaactccaggtagcgaaccggctacttccggttctgaaactccaggtacctctaccgaaccttccgaaggcagcgcacca

SEQ ID NO: 387 - DNA, 108 bp, Artificial Sequence
  Description of Artificial Sequence: Synthetic polynucleotide
ggtagcgaacctgctacttctggttctgaaactccaggtacttctaccgaaccgtccgagggtagcgctccaggtagcgaacctgctacttctggttctgaaactcca

SEQ ID NO: 388 - DNA, 108 bp, Artificial Sequence
  Description of Artificial Sequence: Synthetic polynucleotide
ggtacctctaccgaaccgtccgagggtagcgcaccaggtacctctactgaaccgtctgagggtagcgctccaggtagcgaaccggcaacctccggttctgaaactcca

SEQ ID NO: 389 - DNA, 108 bp, Artificial Sequence
  Description of Artificial Sequence: Synthetic polynucleotide
ggtacttctactgaaccttccgaaggtagcgctccaggtagcgaacctgctacttctggttctgaaaccccaggtagcccggctggctctccgacctccaccgaggaa

SEQ ID NO: 390 - DNA, 108 bp, Artificial Sequence
  Description of Artificial Sequence: Synthetic polynucleotide
ggtagcgaaccggctacttccggctctgagactccaggtagcccagctggttctccaacctctactgaggaaggtacttctgaaagcgctacccctgaatctggtcca

SEQ ID NO: 391 - DNA, 108 bp, Artificial Sequence
  Description of Artificial Sequence: Synthetic polynucleotide
ggtacctctgaaagcgcaactcctgagtctggcccaggtagcgaacctgctacctccggctctgagactccaggtacctctgaaagcgcaaccccggaatctggtcca

SEQ ID NO: 392 - DNA, 36 bp, Artificial Sequence
  Description of Artificial Sequence: Synthetic oligonucleotide
aggttctacyagcgaatcyccktctggyacygcwcc

SEQ ID NO: 393 - DNA, 36 bp, Artificial Sequence
  Description of Artificial Sequence: Synthetic oligonucleotide
acctggwgcrgtrccagamggrgattcgctrgtaga

SEQ ID NO: 394 - DNA, 36 bp, Artificial Sequence
  Description of Artificial Sequence: Synthetic oligonucleotide
aggtacytctacycckgaaagcggytcygcwtctcc

SEQ ID NO: 395 - DNA, 36 bp, Artificial Sequence
  Description of Artificial Sequence: Synthetic oligonucleotide
acctggagawgcrgarccgctttcmggrgtagargt

SEQ ID NO: 396 - DNA, 36 bp, Artificial Sequence
  Description of Artificial Sequence: Synthetic oligonucleotide
aggtacytcycckagcggygaatcttctacygcwcc

SEQ ID NO: 397 - DNA, 36 bp, Artificial Sequence
  Description of Artificial Sequence: Synthetic oligonucleotide
acctggwgcrgtagaagattcrccgctmggrgargt

SEQ ID NO: 398 - DNA, 36 bp, Artificial Sequence
  Description of Artificial Sequence: Synthetic oligonucleotide
aggttcyacyagctctacygcwgaatctcckggycc

SEQ ID NO: 399 - DNA, 36 bp, Artificial Sequence
  Description of Artificial Sequence: Synthetic oligonucleotide
acctggrccmggagattcwgcrgtagagctrgtrga

SEQ ID NO: 400 - protein, 36 aa, Artificial Sequence
  Description of Artificial Sequence: Synthetic polypeptide
GTSTPESGSASPGTSPSGESSTAPGTSPSGESSTAP

SEQ ID NO: 401 - protein, 36 aa, Artificial Sequence
  Description of Artificial Sequence: Synthetic polypeptide
GTSPSGESSTAPGSTSSTAESPGPGTSPSGESSTAP

SEQ ID NO: 402 - protein, 36 aa, Artificial Sequence
  Description of Artificial Sequence: Synthetic polypeptide
GSTSSTAESPGPGTSPSGESSTAPGTSTPESGSASP

SEQ ID NO: 403 - protein, 36 aa, Artificial Sequence
  Description of Artificial Sequence: Synthetic polypeptide
GSTSSTAESPGPGSTSSTAESPGPGTSPSGESSTAP

SEQ ID NO: 404 - protein, 36 aa, Artificial Sequence; identical to SEQ ID NO: 402
  Description of Artificial Sequence: Synthetic polypeptide

SEQ ID NO: 405 - protein, 36 aa, Artificial Sequence
  Description of Artificial Sequence: Synthetic polypeptide
GSTSSTAESPGPGTSTPESGSASPGSTSESPSGTAP

SEQ ID NO: 406 - protein, 36 aa, Artificial Sequence
  Description of Artificial Sequence: Synthetic polypeptide
GSTSSTAESPGPGTSTPESGSASPGTSTPESGSASP

SEQ ID NO: 407 - protein, 36 aa, Artificial Sequence
  Description of Artificial Sequence: Synthetic polypeptide
GSTSESPSGTAPGTSPSGESSTAPGSTSESPSGTAP

SEQ ID NO: 408 - protein, 36 aa, Artificial Sequence; identical to SEQ ID NO: 403
  Description of Artificial Sequence: Synthetic polypeptide

SEQ ID NO: 409 - protein, 36 aa, Artificial Sequence; identical to SEQ ID NO: 405
  Description of Artificial Sequence: Synthetic polypeptide

SEQ ID NO: 410 - protein, 36 aa, Artificial Sequence; identical to SEQ ID NO: 403
  Description of Artificial Sequence: Synthetic polypeptide

SEQ ID NO: 411 - protein, 36 aa, Artificial Sequence
  Description of Artificial Sequence: Synthetic polypeptide
GSTSSTAESPGPGSTSESPSGTAPGSTSSTAESPGP

SEQ ID NO: 412 - protein, 36 aa, Artificial Sequence
  Description of Artificial Sequence: Synthetic polypeptide
GSTSSTAESPGPGSTSSTAESPGPGSTSSTAESPGP

SEQ ID NO: 413 - protein, 36 aa, Artificial Sequence
  Description of Artificial Sequence: Synthetic polypeptide
GSTSESPSGTAPGSTSSTAESPGPGSTSSTAESPGP

SEQ ID NO: 414 - protein, 36 aa, Artificial Sequence
  Description of Artificial Sequence: Synthetic polypeptide
GSTSESPSGTAPGSTSESPSGTAPGSTSESPSGTAP

SEQ ID NO: 415 - protein, 36 aa, Artificial Sequence; identical to SEQ ID NO: 412
  Description of Artificial Sequence: Synthetic polypeptide

SEQ ID NO: 416 - protein, 36 aa, Artificial Sequence; identical to SEQ ID NO: 403
  Description of Artificial Sequence: Synthetic polypeptide

SEQ ID NO: 417 - protein, 36 aa, Artificial Sequence
  Description of Artificial Sequence: Synthetic polypeptide
GSSPSASTGTGPGSSTPSGATGSPGSSTPSGATGSP

SEQ ID NO: 418 - protein, 36 aa, Artificial Sequence
  Description of Artificial Sequence: Synthetic polypeptide
GTSPSGESSTAPGTSTPESGSASPGSTSSTAESPGP

SEQ ID NO: 419 - protein, 36 aa, Artificial Sequence
  Description of Artificial Sequence: Synthetic polypeptide
GSTSSTAESPGPGSTSSTAESPGPGTSTPESGSASP

SEQ ID NO: 420 - protein, 36 aa, Artificial Sequence
  Description of Artificial Sequence: Synthetic polypeptide
GTSPSGESSTAPGSTSSTAESPGPGTSTPESGSASP

SEQ ID NO: 421 - protein, 36 aa, Artificial Sequence; identical to SEQ ID NO: 413
  Description of Artificial Sequence: Synthetic polypeptide

SEQ ID NO: 422 - protein, 36 aa, Artificial Sequence; identical to SEQ ID NO: 411
  Description of Artificial Sequence: Synthetic polypeptide

SEQ ID NO: 423 - protein, 36 aa, Artificial Sequence; identical to SEQ ID NO: 402
  Description of Artificial Sequence: Synthetic polypeptide

SEQ ID NO: 424 - protein, 36 aa, Artificial Sequence
  Description of Artificial Sequence: Synthetic polypeptide
GSTSESPSGTAPGSTSESPSGTAPGTSPSGESSTAP

SEQ ID NO: 425 - protein, 36 aa, Artificial Sequence
  Description of Artificial Sequence: Synthetic polypeptide
GSTSESPSGTAPGSTSESPSGTAPGTSTPESGSASP

SEQ ID NO: 426 - protein, 36 aa, Artificial Sequence
  Description of Artificial Sequence: Synthetic polypeptide
GTSTPESGSASPGSTSSTAESPGPGSTSSTAESPGP

SEQ ID NO: 427 - protein, 36 aa, Artificial Sequence; identical to SEQ ID NO: 424
  Description of Artificial Sequence: Synthetic polypeptide

SEQ ID NO: 428 - protein, 36 aa, Artificial Sequence
  Description of Artificial Sequence: Synthetic polypeptide
GSTSSTAESPGPGSTSSTAESPGPGSTSESPSGTAP

SEQ ID NO: 429 - protein, 36 aa, Artificial Sequence; identical to SEQ ID NO: 419
  Description of Artificial Sequence: Synthetic polypeptide

SEQ ID NO: 430 - protein, 36 aa, Artificial Sequence; identical to SEQ ID NO: 428
  Description of Artificial Sequence: Synthetic polypeptide

SEQ ID NO: 431 - protein, 36 aa, Artificial Sequence
  Description of Artificial Sequence: Synthetic polypeptide
GTSPSGESSTAPGSTSESPSGTAPGSTSSTAESPGP

SEQ ID NO: 432 - protein, 36 aa, Artificial Sequence
  Description of Artificial Sequence: Synthetic polypeptide
GSTSESPSGTAPGTSPSGESSTAPGSTSSTAESPGP

SEQ ID NO: 433 - protein, 36 aa, Artificial Sequence
  Description of Artificial Sequence: Synthetic polypeptide
GSTSSTAESPGPGSTSESPSGTAPGTSPSGESSTAP

SEQ ID NO: 434 - protein, 36 aa, Artificial Sequence; identical to SEQ ID NO: 425
  Description of Artificial Sequence: Synthetic polypeptide

SEQ ID NO: 435 - protein, 36 aa, Artificial Sequence
  Description of Artificial Sequence: Synthetic polypeptide
GTSTPESGSASPGSTSESPSGTAPGSTSSTAESPGP

SEQ ID NO: 436 - protein, 36 aa, Artificial Sequence
  Description of Artificial Sequence: Synthetic polypeptide
GSTSSTAESPGPGTSPSGESSTAPGTSPSGESSTAP

SEQ ID NO: 437 - protein, 36 aa, Artificial Sequence
  Description of Artificial Sequence: Synthetic polypeptide
GTSPSGESSTAPGTSPSGESSTAPGTSPSGESSTAP

SEQ ID NO: 438 - protein, 36 aa, Artificial Sequence; identical to SEQ ID NO: 405
  Description of Artificial Sequence: Synthetic polypeptide

SEQ ID NO: 439 - protein, 36 aa, Artificial Sequence
  Description of Artificial Sequence: Synthetic polypeptide
GSTSESPSGTAPGTSPSGESSTAPGTSPSGESSTAP

SEQ ID NO: 440 - protein, 36 aa, Artificial Sequence
  Description of Artificial Sequence: Synthetic polypeptide
GSTSESPSGTAPGTSTPESGSASPGSTSSTAESPGP

SEQ ID NO: 441 - protein, 36 aa, Artificial Sequence; identical to SEQ ID NO: 428
  Description of Artificial Sequence: Synthetic polypeptide

SEQ ID NO: 442 - protein, 36 aa, Artificial Sequence
  Description of Artificial Sequence: Synthetic polypeptide
GSTSESPSGTAPGTSTPESGSASPGTSTPESGSASP

SEQ ID NO: 443 - protein, 36 aa, Artificial Sequence; identical to SEQ ID NO: 442
  Description of Artificial Sequence: Synthetic polypeptide

SEQ ID NO: 444 - DNA, 108 bp, Artificial Sequence
  Description of Artificial Sequence: Synthetic polynucleotide
ggtacttctactccggaaagcggttccgcatctccaggtacttctcctagcggtgaatcttctactgctccaggtacctctcctagcggcgaatcttctactgctcca

SEQ ID NO: 445 - DNA, 108 bp, Artificial Sequence
  Description of Artificial Sequence: Synthetic polynucleotide
ggtacttctccgagcggtgaatcttctaccgcaccaggttctactagctctaccgctgaatctccgggcccaggtacttctccgagcggtgaatcttctactgctcca

SEQ ID NO: 446 - DNA, 108 bp, Artificial Sequence
  Description of Artificial Sequence: Synthetic polynucleotide
ggttccaccagctctactgctgaatctcctggtccaggtacctctcctagcggtgaatcttctactgctccaggtacttctactcctgaaagcggctctgcttctcca

SEQ ID NO: 447 - DNA, 108 bp, Artificial Sequence
  Description of Artificial Sequence: Synthetic polynucleotide
ggttctaccagctctactgcagaatctcctggcccaggttccaccagctctaccgcagaatctccgggtccaggtacttcccctagcggtgaatcttctaccgcacca

SEQ ID NO: 448 - DNA, 108 bp, Artificial Sequence
  Description of Artificial Sequence: Synthetic polynucleotide
ggttctactagctctactgctgaatctcctggcccaggtacttctcctagcggtgaatcttctaccgctccaggtacctctactccggaaagcggttctgcatctcca

SEQ ID NO: 449 - DNA, 108 bp, Artificial Sequence
  Description of Artificial Sequence: Synthetic polynucleotide
ggttctaccagctctaccgcagaatctcctggtccaggtacctctactccggaaagcggctctgcatctccaggttctactagcgaatctccttctggcactgcacca

SEQ ID NO: 450 - DNA, 108 bp, Artificial Sequence
  Description of Artificial Sequence: Synthetic polynucleotide
ggttctactagctctactgcagaatctcctggcccaggtacctctactccggaaagcggctctgcatctccaggtacttctacccctgaaagcggttctgcatctcca

SEQ ID NO: 451 - DNA, 108 bp, Artificial Sequence
  Description of Artificial Sequence: Synthetic polynucleotide
ggttctaccagcgaatctccttctggcaccgctccaggtacctctcctagcggcgaatcttctaccgctccaggttctactagcgaatctccttctggcactgcacca

SEQ ID NO: 452 - DNA, 108 bp, Artificial Sequence
  Description of Artificial Sequence: Synthetic polynucleotide
ggttccaccagctctactgcagaatctccgggcccaggttctactagctctactgcagaatctccgggtccaggtacttctcctagcggcgaatcttctaccgctcca

SEQ ID NO: 453 - DNA, 108 bp, Artificial Sequence
  Description of Artificial Sequence: Synthetic polynucleotide
ggttccactagctctactgcagaatctcctggcccaggtacctctacccctgaaagcggctctgcatctccaggttctaccagcgaatccccgtctggcaccgcacca

SEQ ID NO: 454 - DNA, 108 bp, Artificial Sequence
  Description of Artificial Sequence: Synthetic polynucleotide
ggttctactagctctactgctgaatctccgggtccaggttctaccagctctactgctgaatctcctggtccaggtacctccccgagcggtgaatcttctactgcacca

SEQ ID NO: 455 - DNA, 108 bp, Artificial Sequence
  Description of Artificial Sequence: Synthetic polynucleotide
ggttctaccagctctaccgctgaatctcctggcccaggttctaccagcgaatccccgtctggcaccgcaccaggttctactagctctaccgctgaatctccgggtcca

SEQ ID NO: 456 - DNA, 108 bp, Artificial Sequence
  Description of Artificial Sequence: Synthetic polynucleotide
ggttctaccagctctaccgcagaatctcctggcccaggttccactagctctaccgctgaatctcctggtccaggttctactagctctaccgctgaatctcctggtcca

SEQ ID NO: 457 - DNA, 108 bp, Artificial Sequence
  Description of Artificial Sequence: Synthetic polynucleotide
ggttctactagcgaatccccttctggtactgctccaggttccactagctctaccgctgaatctcctggcccaggttccactagctctactgcagaatctcctggtcca

SEQ ID NO: 458 - DNA, 108 bp, Artificial Sequence
  Description of Artificial Sequence: Synthetic polynucleotide
ggttctactagcgaatctccttctggtaccgctccaggttctaccagcgaatccccgtctggtactgctccaggttctaccagcgaatctccttctggtactgcacca

SEQ ID NO: 459 - DNA, 108 bp, Artificial Sequence
  Description of Artificial Sequence: Synthetic polynucleotide
ggttccaccagctctactgctgaatctcctggcccaggttctaccagctctactgctgaatctccgggcccaggttccaccagctctaccgctgaatctccgggtcca

SEQ ID NO: 460 - DNA, 108 bp, Artificial Sequence
  Description of Artificial Sequence: Synthetic polynucleotide
ggttccactagctctaccgcagaatctcctggtccaggttctactagctctactgctgaatctccgggtccaggtacctcccctagcggcgaatcttctaccgctcca

SEQ ID NO: 461 - DNA, 108 bp, Artificial Sequence
  Description of Artificial Sequence: Synthetic polynucleotide
ggttctagcccttctgcttccaccggtaccggcccaggtagctctactccgtctggtgcaactggctctccaggtagctctactccgtctggtgcaaccggctcccca

SEQ ID NO: 462 - DNA, 108 bp, Artificial Sequence
  Description of Artificial Sequence: Synthetic polynucleotide
ggtacttcccctagcggtgaatcttctactgctccaggtacctctactccggaaagcggctccgcatctccaggttctactagctctactgctgaatctcctggtcca

SEQ ID NO: 463 - DNA, 108 bp, Artificial Sequence
  Description of Artificial Sequence: Synthetic polynucleotide
ggttctactagctctaccgctgaatctccgggtccaggttctaccagctctactgcagaatctcctggcccaggtacttctactccggaaagcggttccgcttctcca

SEQ ID NO: 464 - DNA, 108 bp, Artificial Sequence
  Description of Artificial Sequence: Synthetic polynucleotide
ggtacttctcctagcggtgaatcttctaccgctccaggttctaccagctctactgctgaatctcctggcccaggtacttctaccccggaaagcggctccgcttctcca

SEQ ID NO: 465 - DNA, 108 bp, Artificial Sequence
  Description of Artificial Sequence: Synthetic polynucleotide
ggttctactagcgaatccccttctggtactgcaccaggttctaccagctctactgctgaatctccgggcccaggttccaccagctctaccgcagaatctcctggtcca

SEQ ID NO: 466 - DNA, 108 bp, Artificial Sequence
  Description of Artificial Sequence: Synthetic polynucleotide
ggttccaccagctctaccgctgaatctccgggcccaggttctaccagcgaatccccttctggcactgcaccaggttctactagctctaccgcagaatctccgggccca

SEQ ID NO: 467 - DNA, 108 bp, Artificial Sequence
  Description of Artificial Sequence: Synthetic polynucleotide
ggttctaccagctctactgctgaatctccgggtccaggtacttccccgagcggtgaatcttctactgcaccaggtacttctactccggaaagcggttccgcttctcca

SEQ ID NO: 468 - DNA, 108 bp, Artificial Sequence
  Description of Artificial Sequence: Synthetic polynucleotide
ggttctaccagcgaatctccttctggcaccgctccaggttctactagcgaatccccgtctggtaccgcaccaggtacttctcctagcggcgaatcttctaccgcacca

SEQ ID NO: 469 - DNA, 108 bp, Artificial Sequence
  Description of Artificial Sequence: Synthetic polynucleotide
ggttctaccagcgaatccccttctggtactgctccaggttctaccagcgaatccccttctggcaccgcaccaggtacttctacccctgaaagcggctccgcttctcca

SEQ ID NO: 470 - DNA, 108 bp, Artificial Sequence
  Description of Artificial Sequence: Synthetic polynucleotide
ggtacctctactcctgaaagcggttctgcatctccaggttccactagctctaccgcagaatctccgggcccaggttctactagctctactgctgaatctcctggccca

SEQ ID NO: 471 - DNA, 108 bp, Artificial Sequence
  Description of Artificial Sequence: Synthetic polynucleotide
ggttctaccagcgaatccccttctggcactgcaccaggttctactagcgaatccccttctggtaccgcaccaggtacttctccgagcggcgaatcttctactgctcca

SEQ ID NO: 472 - DNA, 108 bp, Artificial Sequence
  Description of Artificial Sequence: Synthetic polynucleotide
ggttctactagctctaccgctgaatctcctggcccaggttccactagctctaccgcagaatctccgggcccaggttctactagcgaatccccttctggtaccgctcca

SEQ ID NO: 473 - DNA, 108 bp, Artificial Sequence
  Description of Artificial Sequence: Synthetic polynucleotide
ggttccaccagctctactgcagaatctcctggcccaggttctactagctctaccgcagaatctcctggtccaggtacctctactcctgaaagcggttccgcatctcca

SEQ ID NO: 474 - DNA, 108 bp, Artificial Sequence
  Description of Artificial Sequence: Synthetic polynucleotide
ggttctactagctctactgctgaatctccgggcccaggttctactagctctaccgctgaatctccgggtccaggttctactagcgaatctccttctggtaccgctcca

SEQ ID NO: 475 - DNA, 108 bp, Artificial Sequence
  Description of Artificial Sequence: Synthetic polynucleotide
ggtacctccccgagcggtgaatcttctactgcaccaggttctactagcgaatccccttctggtactgctccaggttccaccagctctactgcagaatctccgggtcca

SEQ ID NO: 476 - DNA, 108 bp, Artificial Sequence
  Description of Artificial Sequence: Synthetic polynucleotide
ggttctactagcgaatccccgtctggtactgctccaggtacttcccctagcggtgaatcttctactgctccaggttctaccagctctaccgcagaatctccgggtcca

SEQ ID NO: 477 - DNA, 108 bp, Artificial Sequence
  Description of Artificial Sequence: Synthetic polynucleotide
ggttctaccagctctaccgctgaatctcctggcccaggttctactagcgaatctccgtctggcaccgcaccaggtacttcccctagcggtgaatcttctactgcacca

SEQ ID NO: 478 - DNA, 108 bp, Artificial Sequence
  Description of Artificial Sequence: Synthetic polynucleotide
ggttctactagcgaatctccttctggcactgcaccaggttctaccagcgaatctccgtctggcactgcaccaggtacctctacccctgaaagcggttccgcttctcca

SEQ ID NO: 479 - DNA, 108 bp, Artificial Sequence
  Description of Artificial Sequence: Synthetic polynucleotide
ggtacctctactccggaaagcggttccgcatctccaggttctaccagcgaatccccgtctggcaccgcaccaggttctactagctctactgctgaatctccgggccca

SEQ ID NO: 480 - DNA, 108 bp, Artificial Sequence
  Description of Artificial Sequence: Synthetic polynucleotide
ggttctactagctctactgcagaatctccgggcccaggtacctctcctagcggtgaatcttctaccgctccaggtacttctccgagcggtgaatcttctaccgctcca

SEQ ID NO: 481 - DNA, 108 bp, Artificial Sequence
  Description of Artificial Sequence: Synthetic polynucleotide
ggtacctcccctagcggcgaatcttctactgctccaggtacctctcctagcggcgaatcttctaccgctccaggtacctcccctagcggtgaatcttctaccgcacca

SEQ ID NO: 482 - DNA, 108 bp, Artificial Sequence
  Description of Artificial Sequence: Synthetic polynucleotide
ggttccactagctctactgctgaatctcctggcccaggtacttctactccggaaagcggttccgcttctccaggttctactagcgaatctccgtctggcaccgcacca

SEQ ID NO: 483 - DNA, 108 bp, Artificial Sequence
  Description of Artificial Sequence: Synthetic polynucleotide
ggttctactagcgaatctccgtctggcactgctccaggtacttctcctagcggtgaatcttctaccgctccaggtacttcccctagcggcgaatcttctaccgctcca

SEQ ID NO: 484 - DNA, 108 bp, Artificial Sequence
  Description of Artificial Sequence: Synthetic polynucleotide
ggttctactagcgaatctccttctggtaccgctccaggtacttctacccctgaaagcggctccgcttctccaggttccactagctctaccgctgaatctccgggtcca

SEQ ID NO: 485 - DNA, 108 bp, Artificial Sequence
  Description of Artificial Sequence: Synthetic polynucleotide
ggttccactagctctactgctgaatctcctggcccaggttctaccagctctaccgctgaatctcctggcccaggttctaccagcgaatctccgtctggcaccgcacca

SEQ ID NO: 486 - DNA, 108 bp, Artificial Sequence
  Description of Artificial Sequence: Synthetic polynucleotide
ggttctactagcgaatccccgtctggtaccgcaccaggtacttctaccccggaaagcggctctgcttctccaggtacttctaccccggaaagcggctccgcatctcca

SEQ ID NO: 487 - DNA, 108 bp, Artificial Sequence
  Description of Artificial Sequence: Synthetic polynucleotide
ggttctactagcgaatccccgtctggtactgctccaggtacttctactcctgaaagcggttccgcttctccaggtacctctactccggaaagcggttctgcatctcca

SEQ ID NO: 488 - DNA, 36 bp, Artificial Sequence
  Description of Artificial Sequence: Synthetic oligonucleotide
aggtacycckggyagcggtacygcwtcttcytctcc

SEQ ID NO: 489 - DNA, 36 bp, Artificial Sequence
  Description of Artificial Sequence: Synthetic oligonucleotide
acctggagargaagawgcrgtaccgctrccmggrgt

SEQ ID NO: 490 - DNA, 36 bp, Artificial Sequence
  Description of Artificial Sequence: Synthetic oligonucleotide
aggtagctctacyccktctggtgcwacyggytcycc

SEQ ID NO: 491 - DNA, 36 bp, Artificial Sequence
  Description of Artificial Sequence: Synthetic oligonucleotide
acctggrgarccrgtwgcaccagamggrgtagagct

SEQ ID NO: 492 - DNA, 36 bp, Artificial Sequence
  Description of Artificial Sequence: Synthetic oligonucleotide
aggttctagcccktctgcwtcyacyggtacyggycc

SEQ ID NO: 493 - DNA, 36 bp, Artificial Sequence
  Description of Artificial Sequence: Synthetic oligonucleotide
acctggrccrgtaccrgtrgawgcagamgggctaga

SEQ ID NO: 494 - DNA, 36 bp, Artificial Sequence
  Description of Artificial Sequence: Synthetic oligonucleotide
aggtgcwtcycckggyacyagctctacyggttctcc

SEQ ID NO: 495 - DNA, 36 bp, Artificial Sequence
  Description of Artificial Sequence: Synthetic oligonucleotide
acctggagaaccrgtagagctrgtrccmggrgawgc

SEQ ID NO: 496 - protein, 36 aa, Artificial Sequence
  Description of Artificial Sequence: Synthetic polypeptide
GASPGTSSTGSPGTPGSGTASSSPGSSTPSGATGSP

SEQ ID NO: 497 - protein, 36 aa, Artificial Sequence
  Description of Artificial Sequence: Synthetic polypeptide
GSSTPSGATGSPGSSPSASTGTGPGSSTPSGATGSP

SEQ ID NO: 498 - protein, 36 aa, Artificial Sequence
  Description of Artificial Sequence: Synthetic polypeptide
GASPGTSSTGSPGSSPSASTGTGPGSSTPSGATGSP

SEQ ID NO: 499 - protein, 36 aa, Artificial Sequence
  Description of Artificial Sequence: Synthetic polypeptide
GTPGSGTASSSPGSSTPSGATGSPGASPGTSSTGSP

SEQ ID NO: 500 - protein, 36 aa, Artificial Sequence
  Description of Artificial Sequence: Synthetic polypeptide
GTPGSGTASSSPGASPGTSSTGSPGSRPSASTGTGP

SEQ ID NO: 501 - protein, 36 aa, Artificial Sequence
  Description of Artificial Sequence: Synthetic polypeptide
GASPGTSSTGSPGSSTPSGATGSPGASPGTSSTGSP

SEQ ID NO: 502 - protein, 36 aa, Artificial Sequence
  Description of Artificial Sequence: Synthetic polypeptide
GTPGSGTASSSPGSSTPSGATGSPGSSTPSGATGSP

SEQ ID NO: 503 - protein, 36 aa, Artificial Sequence
  Description of Artificial Sequence: Synthetic polypeptide
GASPGTSSTGSPGASPGTSSTGSPGASPGTSSTGSP

SEQ ID NO: 504 - protein, 36 aa, Artificial Sequence
  Description of Artificial Sequence: Synthetic polypeptide
GSSTPSGATGSPGSSPSASTGTGPGASPGTSSTGSP

SEQ ID NO: 505 - protein, 36 aa, Artificial Sequence
  Description of Artificial Sequence: Synthetic polypeptide
GSSTPSGATGSPGSSTPSGATGSPGTPGSGTASSSP

SEQ ID NO: 506 - protein, 36 aa, Artificial Sequence
  Description of Artificial Sequence: Synthetic polypeptide
GSSTPSGATGSPGSSTPSGATGSPGASPGTSSTGSP

SEQ ID NO: 507 - protein, 36 aa, Artificial Sequence
  Description of Artificial Sequence: Synthetic polypeptide
GTPGSGTASSSPGSSPSASTGTGPGSSTPSGATGSP

SEQ ID NO: 508 - protein, 36 aa, Artificial Sequence
  Description of Artificial Sequence: Synthetic polypeptide
GASPGTSSTGSPGSSPSASTGTGPGTPGSGTASSSP

SEQ ID NO: 509 - protein, 36 aa, Artificial Sequence; identical to SEQ ID NO: 506
  Description of Artificial Sequence: Synthetic polypeptide

SEQ ID NO: 510 - protein, 36 aa, Artificial Sequence
  Description of Artificial Sequence: Synthetic polypeptide
GTPGSGTASSSPGSSTPSGATGSPGSSPSASTGTGP

SEQ ID NO: 511 - protein, 36 aa, Artificial Sequence
  Description of Artificial Sequence: Synthetic polypeptide
GSSTPSGATGSPGTPGSGTASSSPGTPGSGTASSSP

SEQ ID NO: 512 - protein, 36 aa, Artificial Sequence; identical to SEQ ID NO: 499
  Description of Artificial Sequence: Synthetic polypeptide

SEQ ID NO: 513 - protein, 36 aa, Artificial Sequence; identical to SEQ ID NO: 506
  Description of Artificial Sequence: Synthetic polypeptide

SEQ ID NO: 514 - protein, 36 aa, Artificial Sequence; identical to SEQ ID NO: 496
  Description of Artificial Sequence: Synthetic polypeptide

SEQ ID NO: 515 - protein, 36 aa, Artificial Sequence
  Description of Artificial Sequence: Synthetic polypeptide
GSSPSASTGTGPGSSTPSGATGSPGTPGSGTASSSP

SEQ ID NO: 516 - protein, 36 aa, Artificial Sequence; identical to SEQ ID NO: 498
  Description of Artificial Sequence: Synthetic polypeptide

SEQ ID NO: 517 - protein, 36 aa, Artificial Sequence
  Description of Artificial Sequence: Synthetic polypeptide
GASPGTSSTGSPGSSTPSGATGSPGSSTPSGATGSP

SEQ ID NO: 518 - protein, 36 aa, Artificial Sequence
  Description of Artificial Sequence: Synthetic polypeptide
GTPGSGTASSSPGSSTPSGATGSPGTPGSGTASSSP

SEQ ID NO: 519 - protein, 36 aa, Artificial Sequence; identical to SEQ ID NO: 417
  Description of Artificial Sequence: Synthetic polypeptide

SEQ ID NO: 520 - protein, 36 aa, Artificial Sequence
  Description of Artificial Sequence: Synthetic polypeptide
GASPGTSSTGSPGSSPSASTGTGPGSSPSASTGTGP

SEQ ID NO: 521 - protein, 36 aa, Artificial Sequence
  Description of Artificial Sequence: Synthetic polypeptide
GTPGSGTASSSPGASPGTSSTGSPGASPGTSSTGSP

SEQ ID NO: 522 - protein, 36 aa, Artificial Sequence
  Description of Artificial Sequence: Synthetic polypeptide
GSSTPSGATGSPGASPGTSSTGSPGSSTPSGATGSP

SEQ ID NO: 523 - protein, 36 aa, Artificial Sequence
  Description of Artificial Sequence: Synthetic polypeptide
GSSTPSGATGSPGTPGSGTASSSPGSSTPSGATGSP

SEQ ID NO: 524 - protein, 36 aa, Artificial Sequence; identical to SEQ ID NO: 498
  Description of Artificial Sequence: Synthetic polypeptide

SEQ ID NO: 525 - protein, 36 aa, Artificial Sequence
  Description of Artificial Sequence: Synthetic polypeptide
GSSTPSGATGSPGSSTPSGATGSPGSSTPSGATGSP

SEQ ID NO: 526 - protein, 36 aa, Artificial Sequence
  Description of Artificial Sequence: Synthetic polypeptide
GASPGTSSTGSPGTPGSGTASSSPGASPGTSSTGSP

SEQ ID NO: 527 - protein, 36 aa, Artificial Sequence; identical to SEQ ID NO: 504
  Description of Artificial Sequence: Synthetic polypeptide

SEQ ID NO: 528 - protein, 36 aa, Artificial Sequence
  Description of Artificial Sequence: Synthetic polypeptide
GASPGTSSTGSPGSSTPSGATGSPGSSPSASTGTGP

SEQ ID NO: 529 - protein, 36 aa, Artificial Sequence; identical to SEQ ID NO: 499
  Description of Artificial Sequence: Synthetic polypeptide

SEQ ID NO: 530 - protein, 36 aa, Artificial Sequence; identical to SEQ ID NO: 523
  Description of Artificial Sequence: Synthetic polypeptide

SEQ ID NO: 531 - protein, 36 aa, Artificial Sequence
  Description of Artificial Sequence: Synthetic polypeptide
GSSPSASTGTGPGSSPSASTGTGPGASPGTSSTGSP

SEQ ID NO: 532 - protein, 36 aa, Artificial Sequence
  Description of Artificial Sequence: Synthetic polypeptide
GTPGSGTASSSPGSSTPSGATGSPGSNPSASTGTGP

SEQ ID NO: 533 - protein, 36 aa, Artificial Sequence
  Description of Artificial Sequence: Synthetic polypeptide
GSSPSASTGTGPGSSTPSGATGSPGASPGTSSTGSP

SEQ ID NO: 534 - protein, 36 aa, Artificial Sequence
  Description of Artificial Sequence: Synthetic polypeptide
GSSTPSGATGSPGASPGTSSTGSPGTPGSGTASSSP

SEQ ID NO: 535 - protein, 36 aa, Artificial Sequence; identical to SEQ ID NO: 525
  Description of Artificial Sequence: Synthetic polypeptide

SEQ ID NO: 536 - protein, 36 aa, Artificial Sequence; identical to SEQ ID NO: 496
  Description of Artificial Sequence: Synthetic polypeptide

SEQ ID NO: 537 - protein, 36 aa, Artificial Sequence
  Description of Artificial Sequence: Synthetic polypeptide
GSSTPSGATGSPGSSPSASTGTGPGSSPSASTGTGP

SEQ ID NO: 538 - protein, 36 aa, Artificial Sequence; identical to SEQ ID NO: 520
  Description of Artificial Sequence: Synthetic polypeptide

SEQ ID NO: 539 - protein, 36 aa, Artificial Sequence; identical to SEQ ID NO: 508
  Description of Artificial Sequence: Synthetic polypeptide

SEQ ID NO: 540 - DNA, 108 bp, Artificial Sequence
  Description of Artificial Sequence: Synthetic polynucleotide
ggtgcatccccgggcactagctctaccggttctccaggtactcctggtagcggtactgcttcttcttctccaggtagctctactccttctggtgctactggttctcca

SEQ ID NO: 541 - DNA, 108 bp, Artificial Sequence
  Description of Artificial Sequence: Synthetic polynucleotide
ggtagctctaccccttctggtgctaccggctctccaggttctagcccgtctgcttctaccggtaccggtccaggtagctctaccccttctggtgctactggttctcca

SEQ ID NO: 542 - DNA, 108 bp, Artificial Sequence
  Description of Artificial Sequence: Synthetic polynucleotide
ggtgcatctccgggtactagctctaccggttctccaggttctagcccttctgcttccactggtaccggcccaggtagctctaccccgtctggtgctactggttcccca

SEQ ID NO: 543 - DNA, 108 bp, Artificial Sequence
  Description of Artificial Sequence: Synthetic polynucleotide
ggtactccgggcagcggtactgcttcttcctctccaggtagctctaccccttctggtgcaactggttccccaggtgcatcccctggtactagctctaccggttctcca

SEQ ID NO: 544 - DNA, 108 bp, Artificial Sequence
  Description of Artificial Sequence: Synthetic polynucleotide
ggtacccctggcagcggtactgcttcttcttctccaggtgcttcccctggtaccagctctaccggttctccaggttctagaccttctgcatccaccggtactggtcca

SEQ ID NO: 545 - DNA, 108 bp, Artificial Sequence
  Description of Artificial Sequence: Synthetic polynucleotide
ggtgcatctcctggtaccagctctaccggttctccaggtagctctactccttctggtgctactggctctccaggtgcttccccgggtaccagctctaccggttctcca

SEQ ID NO: 546 - DNA, 108 bp, Artificial Sequence
  Description of Artificial Sequence: Synthetic polynucleotide
ggtaccccgggcagcggtaccgcatcttcctctccaggtagctctaccccgtctggtgctaccggttccccaggtagctctaccccgtctggtgcaaccggctcccca

SEQ ID NO: 547 - DNA, 108 bp, Artificial Sequence
  Description of Artificial Sequence: Synthetic polynucleotide
ggtgcatctccgggcactagctctactggttctccaggtgcatcccctggcactagctctactggttctccaggtgcttctcctggtaccagctctactggttctcca

SEQ ID NO: 548 - DNA, 108 bp, Artificial Sequence
  Description of Artificial Sequence: Synthetic polynucleotide
ggtagctctactccgtctggtgcaaccggctccccaggttctagcccgtctgcttccactggtactggcccaggtgcttccccgggcaccagctctactggttctcca

SEQ ID NO: 549 - DNA, 108 bp, Artificial Sequence
  Description of Artificial Sequence: Synthetic polynucleotide
ggtagctctactccttctggtgctaccggttccccaggtagctctactccttctggtgctactggttccccaggtactccgggcagcggtactgcttcttcctctcca

SEQ ID NO: 550 - DNA, 108 bp, Artificial Sequence
  Description of Artificial Sequence: Synthetic polynucleotide
ggtagctctactccgtctggtgcaaccggttccccaggtagctctactccttctggtgctactggctccccaggtgcatcccctggcaccagctctaccggttctcca

SEQ ID NO: 551 - DNA, 108 bp, Artificial Sequence
  Description of Artificial Sequence: Synthetic polynucleotide
ggtactcctggtagcggtaccgcatcttcctctccaggttctagcccttctgcatctaccggtaccggtccaggtagctctactccttctggtgctactggctctcca

SEQ ID NO: 552 - DNA, 108 bp, Artificial Sequence
  Description of Artificial Sequence: Synthetic polynucleotide
ggtgcttccccgggcactagctctaccggttctccaggttctagcccttctgcatctactggtactggcccaggtactccgggcagcggtactgcttcttcctctcca

SEQ ID NO: 553 - DNA, 108 bp, Artificial Sequence
  Description of Artificial Sequence: Synthetic polynucleotide
ggtagctctactccgtctggtgctaccggctctccaggtagctctaccccttctggtgcaaccggctccccaggtgcttctccgggtaccagctctactggttctcca

SEQ ID NO: 554 - DNA, 108 bp, Artificial Sequence
  Description of Artificial Sequence: Synthetic polynucleotide
ggtacccctggcagcggtaccgcttcttcctctccaggtagctctaccccgtctggtgctactggctctccaggttctagcccgtctgcatctaccggtaccggccca

SEQ ID NO: 555 - DNA, 108 bp, Artificial Sequence
  Description of Artificial Sequence: Synthetic polynucleotide
ggtagctctactccttctggtgcaaccggctccccaggtaccccgggcagcggtaccgcatcttcctctccaggtactccgggtagcggtactgcttcttcttctcca

SEQ ID NO: 556 - DNA, 108 bp, Artificial Sequence
  Description of Artificial Sequence: Synthetic polynucleotide
ggtaccccgggtagcggtactgcttcttcctctccaggtagctctaccccttctggtgcaaccggctctccaggtgcttctccgggcaccagctctaccggttctcca

SEQ ID NO: 557 - DNA, 108 bp, Artificial Sequence
  Description of Artificial Sequence: Synthetic polynucleotide
ggtagctctaccccgtctggtgctaccggctctccaggtagctctaccccgtctggtgcaaccggctccccaggtgcatccccgggtactagctctaccggttctcca

SEQ ID NO: 558 - DNA, 108 bp, Artificial Sequence
  Description of Artificial Sequence: Synthetic polynucleotide
ggtgcttctccgggcaccagctctactggttctccaggtaccccgggcagcggtaccgcatcttcttctccaggtagctctactccttctggtgcaactggttctcca

SEQ ID NO: 559 - DNA, 108 bp, Artificial Sequence
  Description of Artificial Sequence: Synthetic polynucleotide
ggttctagcccgtctgcttccaccggtactggcccaggtagctctaccccgtctggtgcaactggttccccaggtacccctggtagcggtaccgcttcttcttctcca

SEQ ID NO: 560 - DNA, 108 bp, Artificial Sequence
  Description of Artificial Sequence: Synthetic polynucleotide
ggtgcttctccgggcaccagctctactggttctccaggttctagcccttctgcatccaccggtaccggtccaggtagctctaccccttctggtgcaaccggctctcca

SEQ ID NO: 561 - DNA, 108 bp, Artificial Sequence
  Description of Artificial Sequence: Synthetic polynucleotide
ggtgcatccccgggcaccagctctaccggttctccaggtagctctaccccgtctggtgctaccggctctccaggtagctctaccccgtctggtgctactggctctcca

SEQ ID NO: 562 - DNA, 108 bp, Artificial Sequence
  Description of Artificial Sequence: Synthetic polynucleotide
ggtacccctggtagcggtactgcttcttcctctccaggtagctctactccgtctggtgctaccggttctccaggtaccccgggtagcggtaccgcatcttcttctcca

SEQ ID NO: 563 - DNA, 108 bp, Artificial Sequence
  Description of Artificial Sequence: Synthetic polynucleotide
ggttctagcccttctgcttccaccggtactggcccaggtagctctaccccttctggtgctaccggctccccaggtagctctactccttctggtgcaactggctctcca

SEQ ID NO: 564 - DNA, 108 bp, Artificial Sequence
  Description of Artificial Sequence: Synthetic polynucleotide
ggtgcttctcctggcaccagctctactggttctccaggttctagcccttctgcttctaccggtactggtccaggttctagcccttctgcatccactggtactggtcca

SEQ ID NO: 565 - DNA, 108 bp, Artificial Sequence
  Description of Artificial Sequence: Synthetic polynucleotide
ggtactcctggcagcggtaccgcttcttcttctccaggtgcttctcctggtactagctctactggttctccaggtgcttctccgggcactagctctactggttctcca

SEQ ID NO: 566 - DNA, 108 bp, Artificial Sequence
  Description of Artificial Sequence: Synthetic polynucleotide
ggtagctctaccccgtctggtgctaccggttccccaggtgcttctcctggtactagctctaccggttctccaggtagctctaccccgtctggtgctactggctctcca

SEQ ID NO: 567 - DNA, 108 bp, Artificial Sequence
  Description of Artificial Sequence: Synthetic polynucleotide
ggtagctctaccccgtctggtgctactggttctccaggtactccgggcagcggtactgcttcttcctctccaggtagctctaccccttctggtgctactggctctcca

SEQ ID NO: 568 - DNA, 108 bp, Artificial Sequence
  Description of Artificial Sequence: Synthetic polynucleotide
ggtgcatctcctggtaccagctctactggttctccaggttctagcccttctgcttctaccggtaccggtccaggtagctctactccttctggtgctaccggttctcca

SEQ ID NO: 569 - DNA, 108 bp, Artificial Sequence
  Description of Artificial Sequence: Synthetic polynucleotide
ggtagctctaccccgtctggtgctactggctctccaggtagctctactccttctggtgctactggttccccaggtagctctaccccgtctggtgcaactggctctcca

SEQ ID NO: 570 - DNA, 108 bp, Artificial Sequence
  Description of Artificial Sequence: Synthetic polynucleotide
ggtgcatccccgggtaccagctctaccggttctccaggtactcctggcagcggtactgcatcttcctctccaggtgcttctccgggcaccagctctactggttctcca

SEQ ID NO: 571 - DNA, 108 bp, Artificial Sequence
  Description of Artificial Sequence: Synthetic polynucleotide
ggtagctctactccttctggtgcaactggttctccaggttctagcccgtctgcatccactggtaccggtccaggtgcttcccctggcaccagctctaccggttctcca

SEQ ID NO: 572 - DNA, 108 bp, Artificial Sequence
  Description of Artificial Sequence: Synthetic polynucleotide
ggtgcatctcctggtactagctctactggttctccaggtagctctactccgtctggtgcaaccggctctccaggttctagcccttctgcatctaccggtactggtcca

SEQ ID NO: 573 - DNA, 108 bp, Artificial Sequence
  Description of Artificial Sequence: Synthetic polynucleotide
ggtactcctggcagcggtaccgcatcttcctctccaggtagctctactccgtctggtgcaactggttccccaggtgcttctccgggtaccagctctaccggttctcca

SEQ ID NO: 574 - DNA, 108 bp, Artificial Sequence
  Description of Artificial Sequence: Synthetic polynucleotide
ggtagctctaccccgtctggtgcaaccggctccccaggtactcctggtagcggtaccgcttcttcttctccaggtagctctactccgtctggtgctaccggctcccca

SEQ ID NO: 575 - DNA, 108 bp, Artificial Sequence
  Description of Artificial Sequence: Synthetic polynucleotide
ggttctagcccttctgcatccaccggtaccggcccaggttctagcccgtctgcttctaccggtactggtccaggtgcttctccgggtactagctctactggttctcca

SEQ ID NO: 576 - DNA, 108 bp, Artificial Sequence
  Description of Artificial Sequence: Synthetic polynucleotide
ggtaccccgggtagcggtaccgcttcttcttctccaggtagctctactccgtctggtgctaccggctctccaggttctaacccttctgcatccaccggtaccggccca

SEQ ID NO: 577 - DNA, 108 bp, Artificial Sequence
  Description of Artificial Sequence: Synthetic polynucleotide
ggttctagcccttctgcatctactggtactggcccaggtagctctactccttctggtgctaccggctctccaggtgcttctccgggtactagctctaccggttctcca

SEQ ID NO: 578 - DNA, 108 bp, Artificial Sequence
  Description of Artificial Sequence: Synthetic polynucleotide
ggtagctctaccccttctggtgcaaccggctctccaggtgcatccccgggtaccagctctaccggttctccaggtactccgggtagcggtaccgcttcttcctctcca

SEQ ID NO: 579 - DNA, 108 bp, Artificial Sequence
  Description of Artificial Sequence: Synthetic polynucleotide
ggtagctctactccgtctggtgcaaccggttccccaggtagctctaccccttctggtgcaaccggctccccaggtagctctaccccttctggtgcaactggctctcca

SEQ ID NO: 580 - DNA, 108 bp, Artificial Sequence
  Description of Artificial Sequence: Synthetic polynucleotide
ggtgcttctcctggcactagctctaccggttctccaggtacccctggtagcggtaccgcatcttcctctccaggtagctctactccttctggtgctactggttcccca

SEQ ID NO: 581 - DNA, 108 bp, Artificial Sequence
  Description of Artificial Sequence: Synthetic polynucleotide
ggtagctctaccccgtctggtgctactggctccccaggttctagcccttctgcatccaccggtaccggtccaggttctagcccgtctgcatctactggtactggtcca

SEQ ID NO: 582 - DNA, 108 bp, Artificial Sequence
  Description of Artificial Sequence: Synthetic polynucleotide
ggtgcttccccgggcaccagctctactggttctccaggttctagcccgtctgcttctactggtactggtccaggttctagcccttctgcttccactggtactggtcca

SEQ ID NO: 583 - DNA, 108 bp, Artificial Sequence
  Description of Artificial Sequence: Synthetic polynucleotide
ggtgcttccccgggtaccagctctaccggttctccaggttctagcccttctgcttctaccggtaccggtccaggtacccctggcagcggtaccgcatcttcctctcca

SEQ ID NO: 584 - DNA, 432 bp, Artificial Sequence
  Description of Artificial Sequence: Synthetic polynucleotide
ggtaccccgggcagcggtaccgcatcttcctctccaggtagctctaccccgtctggtgctaccggttccccaggtagctctaccccgtctggtgcaaccggctccccaggtagcccggctggctctcctacctctactgaggaaggtacttctgaaagcgctactcctgagtctggtccaggtacctctactgaaccgtccgaaggtagcgctccaggttctagcccttctgcatccaccggtaccggcccaggttctagcccgtctgcttctaccggtactggtccaggtgcttctccgggtactagctctactggttctccaggtacctctaccgaaccgtccgagggtagcgcaccaggtacctctactgaaccgtctgagggtagcgctccaggtagcgaaccggcaacctccggttctgaaactcca

SEQ ID NO: 585 - DNA, 432 bp, Artificial Sequence
  Description of Artificial Sequence: Synthetic polynucleotide
ggttctaccagcgaatccccttctggcactgcaccaggttctactagcgaatccccttctggtaccgcaccaggtacttctccgagcggcgaatcttctactgctccaggtacctctactgaaccttccgaaggcagcgctccaggtacctctaccgaaccgtccgagggcagcgcaccaggtacttctgaaagcgcaacccctgaatccggtccaggtgcatctcctggtaccagctctaccggttctccaggtagctctactccttctggtgctactggctctccaggtgcttccccgggtaccagctctaccggttctccaggttctactagcgaatctccttctggcactgcaccaggttctaccagcgaatctccgtctggcactgcaccaggtacctctacccctgaaagcggttccgcttctcca

SEQ ID NO: 586 - DNA, 432 bp, Artificial Sequence
  Description of Artificial Sequence: Synthetic polynucleotide
ggtacttctaccgaaccttccgagggcagcgcaccaggtacttctgaaagcgctacccctgagtccggcccaggtacttctgaaagcgctactcctgaatccggtccaggtacctctactgaaccttctgagggcagcgctccaggtacttctgaaagcgctaccccggagtccggtccaggtacttctactgaaccgtccgaaggtagcgcaccaggtacttctactgaaccttccgaaggtagcgctccaggtagcgaacctgctacttctggttctgaaaccccaggtagcccggctggctctccgacctccaccgaggaaggtgcttctcctggcaccagctctactggttctccaggttctagcccttctgcttctaccggtactggtccaggttctagcccttctgcatccactggtactggtcca

SEQ ID NO: 587 - DNA, 432 bp, Artificial Sequence
  Description of Artificial Sequence: Synthetic polynucleotide
ggtagcgaaccggcaacctctggctctgaaaccccaggtacctctgaaagcgctactccggaatctggtccaggtacttctgaaagcgctactccggaatccggtccaggttctaccagcgaatctccttctggcaccgctccaggttctactagcgaatccccgtctggtaccgcaccaggtacttctcctagcggcgaatcttctaccgcaccaggtgcatctccgggtactagctctaccggttctccaggttctagcccttctgcttccactggtaccggcccaggtagctctaccccgtctggtgctactggttccccaggtagctctactccgtctggtgcaaccggttccccaggtagctctactccttctggtgctactggctccccaggtgcatcccctggcaccagctctaccggttctcca

SEQ ID NO: 588 - DNA, 432 bp, Artificial Sequence
  Description of Artificial Sequence: Synthetic polynucleotide
ggtgcttctccgggcaccagctctactggttctccaggttctagcccttctgcatccaccggtaccggtccaggtagctctaccccttctggtgcaaccggctctccaggtacttctgaaagcgctaccccggaatctggcccaggtagcgaaccggctacttctggttctgaaaccccaggtagcgaaccggctacctccggttctgaaactccaggtacttctgaaagcgctactccggagtccggtccaggtacctctaccgaaccgtccgaaggcagcgctccaggtacttctactgaaccttctgagggtagcgctccaggtacctctaccgaaccgtccgagggtagcgcaccaggtacctctactgaaccgtctgagggtagcgctccaggtagcgaaccggcaacctccggttctgaaactcca

SEQ ID NO: 589 - DNA, 432 bp, Artificial Sequence
  Description of Artificial Sequence: Synthetic polynucleotide
ggtacctctaccgaaccttccgaaggtagcgctccaggtagcccggcaggttctcctacttccactgaggaaggtacttctaccgaaccttctgagggtagcgcaccaggtacctctgaaagcgcaactcctgagtctggcccaggtagcgaacctgctacctccggctctgagactccaggtacctctgaaagcgcaaccccggaatctggtccaggtagcccggctggctctcctacctctactgaggaaggtacttctgaaagcgctactcctgagtctggtccaggtacctctactgaaccgtccgaaggtagcgctccaggtagcgaacctgctacttctggttctgaaactccaggtacttctaccgaaccgtccgagggtagcgctccaggtagcgaacctgctacttctggttctgaaactcca

SEQ ID NO: 590 - DNA, 432 bp, Artificial Sequence
  Description of Artificial Sequence: Synthetic polynucleotide
ggtacttctaccgaaccgtccgaaggcagcgctccaggtacctctactgaaccttccgagggcagcgctccaggtacctctaccgaaccttctgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccttccgagggcagcgcaccaggtacttctgaaagcgctacccctgagtccggcccaggtacttctgaaagcgctactcctgaatccggtccaggtacttctactgaaccttccgaaggtagcgctccaggtagcgaacctgctacttctggttctgaaaccccaggtagcccggctggctctccgacctccaccgaggaa

SEQ ID NO: 591 - DNA, 432 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcaccaggttctaccagcgaatccccttctggtactgctccaggttctaccagcgaatccccttctggcaccgcaccaggtacttctacccctgaaagcggctccgcttctccaggtagcgaacctgcaacctctggctctgaaaccccaggtacctctgaaagcgctactcctgaatctggcccaggtacttctactgaaccgtccgagggcagcgcaccaggtacttctactgaaccgtctgaaggtagcgcaccaggtacttctgaaagcgcaaccccggaatccggcccaggtacctctgaaagcgcaaccccggagtccggccca

SEQ ID NO: 592 - DNA, 432 bp, Artificial Sequence
  Description of Artificial Sequence: Synthetic polynucleotide
ggtagctctaccccttctggtgctaccggctctccaggttctagcccgtctgcttctaccggtaccggtccaggtagctctaccccttctggtgctactggttctccaggtagccctgctggctctccgacttctactgaggaaggtagcccggctggttctccgacttctactgaggaaggtacttctaccgaaccttccgaaggtagcgctccaggtgcttccccgggcactagctctaccggttctccaggttctagcccttctgcatctactggtactggcccaggtactccgggcagcggtactgcttcttcctctccaggttctactagctctactgctgaatctcctggcccaggtacttctcctagcggtgaatcttctaccgctccaggtacctctactccggaaagcggttctgcatctcca

SEQ ID NO: 593 - DNA, 432 bp, Artificial Sequence
  Description of Artificial Sequence: Synthetic polynucleotide
ggtacctctactgaaccttctgagggcagcgctccaggtacttctgaaagcgctaccccggagtccggtccaggtacttctactgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtactcctggcagcggtaccgcttcttcttctccaggtgcttctcctggtactagctctactggttctccaggtgcttctccgggcactagctctactggttctccaggtagccctgctggctctccgacttctactgaggaaggtagcccggctggttctccgacttctactgaggaaggtacttctaccgaaccttccgaaggtagcgctcca

SEQ ID NO: 594 - DNA, 432 bp, Artificial Sequence
  Description of Artificial Sequence: Synthetic polynucleotide
ggtagcccagcaggctctccgacttccactgaggaaggtacttctactgaaccttccgaaggcagcgcaccaggtacctctactgaaccttctgagggcagcgctccaggtacctctaccgaaccgtctgaaggtagcgcaccaggtacctctgaaagcgcaactcctgagtccggtccaggtacttctgaaagcgcaaccccggagtctggcccaggtaccccgggtagcggtactgcttcttcctctccaggtagctctaccccttctggtgcaaccggctctccaggtgcttctccgggcaccagctctaccggttctccaggtacctctactgaaccttctgagggcagcgctccaggtacttctgaaagcgctaccccggagtccggtccaggtacttctactgaaccgtccgaaggtagcgcacca

SEQ ID NO: 595 - DNA, 432 bp, Artificial Sequence
  Description of Artificial Sequence: Synthetic polynucleotide
ggtagcgaaccggcaacctccggctctgaaactccaggtacttctgaaagcgctactccggaatccggcccaggtagcgaaccggctacttccggctctgaaaccccaggtagctctaccccgtctggtgcaaccggctccccaggtactcctggtagcggtaccgcttcttcttctccaggtagctctactccgtctggtgctaccggctccccaggtgcatctcctggtaccagctctaccggttctccaggtagctctactccttctggtgctactggctctccaggtgcttccccgggtaccagctctaccggttctccaggtagcgaacctgctacttctggttctgaaactccaggtacttctaccgaaccgtccgagggtagcgctccaggtagcgaacctgctacttctggttctgaaactcca

SEQ ID NO: 596 - DNA, 432 bp, Artificial Sequence
  Description of Artificial Sequence: Synthetic polynucleotide
ggtacctctactgaaccttccgaaggcagcgctccaggtacctctaccgaaccgtccgagggcagcgcaccaggtacttctgaaagcgcaacccctgaatccggtccaggtagccctgctggctctccgacttctactgaggaaggtagcccggctggttctccgacttctactgaggaaggtacttctaccgaaccttccgaaggtagcgctccaggtagcccggctggttctccgacttccaccgaggaaggtacctctactgaaccttctgagggtagcgctccaggtacctctactgaaccttccgaaggcagcgctccaggtgcttccccgggcaccagctctactggttctccaggttctagcccgtctgcttctactggtactggtccaggttctagcccttctgcttccactggtactggtcca

SEQ ID NO: 597 - DNA, 432 bp, Artificial Sequence
  Description of Artificial Sequence: Synthetic polynucleotide
ggtagctctaccccgtctggtgctaccggttccccaggtgcttctcctggtactagctctaccggttctccaggtagctctaccccgtctggtgctactggctctccaggtagccctgctggctctccaacctccaccgaagaaggtacctctgaaagcgcaacccctgaatccggcccaggtagcgaaccggcaacctccggttctgaaaccccaggtgcatctcctggtactagctctactggttctccaggtagctctactccgtctggtgcaaccggctctccaggttctagcccttctgcatctaccggtactggtccaggttctaccagcgaatccccttctggtactgctccaggttctaccagcgaatccccttctggcaccgcaccaggtacttctacccctgaaagcggctccgcttctcca

SEQ ID NO: 598 - DNA, 432 bp, Artificial Sequence
  Description of Artificial Sequence: Synthetic polynucleotide
ggttctaccagcgaatctccttctggcaccgctccaggttctactagcgaatccccgtctggtaccgcaccaggtacttctcctagcggcgaatcttctaccgcaccaggtacctctgaaagcgctactccggagtctggcccaggtacctctactgaaccgtctgagggtagcgctccaggtacttctactgaaccgtccgaaggtagcgcaccaggtacctctactgaaccttctgagggcagcgctccaggtacttctgaaagcgctaccccggagtccggtccaggtacttctactgaaccgtccgaaggtagcgcaccaggtagctctaccccgtctggtgctaccggttccccaggtgcttctcctggtactagctctaccggttctccaggtagctctaccccgtctggtgctactggctctcca

SEQ ID NO: 599 - DNA, 432 bp, Artificial Sequence
  Description of Artificial Sequence: Synthetic polynucleotide
ggttctactagctctactgcagaatctccgggcccaggtacctctcctagcggtgaatcttctaccgctccaggtacttctccgagcggtgaatcttctaccgctccaggttctactagctctaccgctgaatctccgggtccaggttctaccagctctactgcagaatctcctggcccaggtacttctactccggaaagcggttccgcttctccaggtacttctcctagcggtgaatcttctaccgctccaggttctaccagctctactgctgaatctcctggcccaggtacttctaccccggaaagcggctccgcttctccaggttctaccagctctaccgctgaatctcctggcccaggttctactagcgaatctccgtctggcaccgcaccaggtacttcccctagcggtgaatcttctactgcacca

SEQ ID NO: 600 - DNA, 432 bp, Artificial Sequence
  Description of Artificial Sequence: Synthetic polynucleotide
ggtacctctactccggaaagcggttccgcatctccaggttctaccagcgaatccccgtctggcaccgcaccaggttctactagctctactgctgaatctccgggcccaggtacctctactgaaccttccgaaggcagcgctccaggtacctctaccgaaccgtccgagggcagcgcaccaggtacttctgaaagcgcaacccctgaatccggtccaggtacctctgaaagcgctactccggagtctggcccaggtacctctactgaaccgtctgagggtagcgctccaggtacttctactgaaccgtccgaaggtagcgcaccaggtacttctgaaagcgctactccggagtccggtccaggtacctctaccgaaccgtccgaaggcagcgctccaggtacttctactgaaccttctgagggtagcgctccc

SEQ ID NO: 601 - DNA, 432 bp, Artificial Sequence
  Description of Artificial Sequence: Synthetic polynucleotide
ggtacctctaccgaaccgtccgagggtagcgcaccaggtacctctactgaaccgtctgagggtagcgctccaggtagcgaaccggcaacctccggttctgaaactccaggtacttctactgaaccgtctgaaggtagcgcaccaggtacttctgaaagcgcaaccccggaatccggcccaggtacctctgaaagcgcaaccccggagtccggcccaggtgcatctccgggtactagctctaccggttctccaggttctagcccttctgcttccactggtaccggcccaggtagctctaccccgtctggtgctactggttccccaggtagctctactccgtctggtgcaaccggttccccaggtagctctactccttctggtgctactggctccccaggtgcatcccctggcaccagctctaccggttctcca

SEQ ID NO: 602 - DNA, 432 bp, Artificial Sequence
  Description of Artificial Sequence: Synthetic polynucleotide
ggtagcgaaccggcaacctctggctctgaaactccaggtagcgaacctgcaacctccggctctgaaaccccaggtacttctactgaaccttctgagggcagcgcaccaggtagcgaacctgcaacctctggctctgaaaccccaggtacctctgaaagcgctactcctgaatctggcccaggtacttctactgaaccgtccgagggcagcgcaccaggtagctctactccgtctggtgctaccggctctccaggtagctctaccccttctggtgcaaccggctccccaggtgcttctccgggtaccagctctactggttctccaggtagctctaccccgtctggtgctaccggttccccaggtgcttctcctggtactagctctaccggttctccaggtagctctaccccgtctggtgctactggctctcca

SEQ ID NO: 603 - DNA, 432 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcaccaggtacttctgaaagcgctactccggagtccggtccaggtacctctaccgaaccgtccgaaggcagcgctccaggtacttctactgaaccttctgagggtagcgctccaggttctactagcgaatctccgtctggcactgctccaggtacttctcctagcggtgaatcttctaccgctccaggtacttcccctagcggcgaatcttctaccgctccaggtagcccggctggctctcctacctctactgaggaaggtacttctgaaagcgctactcctgagtctggtccaggtacctctactgaaccgtccgaaggtagcgctcca

SEQ ID NO: 604 - DNA, 432 bp, Artificial Sequence
  Description of Artificial Sequence: Synthetic polynucleotide
ggtacttctactgaaccttccgaaggtagcgctccaggtagcgaacctgctacttctggttctgaaaccccaggtagcccggctggctctccgacctccaccgaggaaggtagcccggcaggctctccgacctctactgaggaaggtacttctgaaagcgcaaccccggagtccggcccaggtacctctaccgaaccgtctgagggcagcgcaccaggtacctctactgaaccttccgaaggcagcgctccaggtacctctaccgaaccgtccgagggcagcgcaccaggtacttctgaaagcgcaacccctgaatccggtccaggtagctctactccgtctggtgcaaccggctccccaggttctagcccgtctgcttccactggtactggcccaggtgcttccccgggcaccagctctactggttctcca

SEQ ID NO: 605 - DNA, 432 bp, Artificial Sequence
  Description of Artificial Sequence: Synthetic polynucleotide
ggtagcgaaccggctacttccggctctgagactccaggtagccctgctggctctccgacctctaccgaagaaggtacctctgaaagcgctacccctgagtctggcccaggtacctctactgaaccttccgaaggcagcgctccaggtacctctaccgaaccgtccgagggcagcgcaccaggtacttctgaaagcgcaacccctgaatccggtccaggtacctctactccggaaagcggttccgcatctccaggttctaccagcgaatccccgtctggcaccgcaccaggttctactagctctactgctgaatctccgggcccaggtacttctgaaagcgctactccggagtccggtccaggtacctctaccgaaccgtccgaaggcagcgctccaggtacttctactgaaccttctgagggtagcgctcca

SEQ ID NO: 606 - DNA, 432 bp, Artificial Sequence
  Description of Artificial Sequence: Synthetic polynucleotide
ggtacttctaccgaaccgtccgagggcagcgctccaggtacttctactgaaccttctgaaggcagcgctccaggtacttctactgaaccttccgaaggtagcgcaccaggtacctctaccgaaccgtctgaaggtagcgcaccaggtacctctgaaagcgcaactcctgagtccggtccaggtacttctgaaagcgcaaccccggagtctggcccaggtactcctggcagcggtaccgcatcttcctctccaggtagctctactccgtctggtgcaactggttccccaggtgcttctccgggtaccagctctaccggttctccaggttccaccagctctactgctgaatctcctggtccaggtacctctcctagcggtgaatcttctactgctccaggtacttctactcctgaaagcggctctgcttctcca

SEQ ID NO: 607 - DNA, 432 bp, Artificial Sequence
  Description of Artificial Sequence: Synthetic polynucleotide
ggtagcccggcaggctctccgacctctactgaggaaggtacttctgaaagcgcaaccccggagtccggcccaggtacctctaccgaaccgtctgagggcagcgcaccaggtacttctgaaagcgcaacccctgaatccggtccaggtagcgaaccggctacttctggctctgagactccaggtacttctaccgaaccgtccgaaggtagcgcaccaggtagcccggctggttctccgacttccaccgaggaaggtacctctactgaaccttctgagggtagcgctccaggtacctctactgaaccttccgaaggcagcgctccaggtacttctaccgaaccgtccgagggcagcgctccaggtacttctactgaaccttctgaaggcagcgctccaggtacttctactgaaccttccgaaggtagcgcacca

SEQ ID NO: 608 - DNA, 432 bp, Artificial Sequence
  Description of Artificial Sequence: Synthetic polynucleotide
ggtacttctccgagcggtgaatcttctaccgcaccaggttctactagctctaccgctgaatctccgggcccaggtacttctccgagcggtgaatcttctactgctccaggtacctctgaaagcgctactccggagtctggcccaggtacctctactgaaccgtctgagggtagcgctccaggtacttctactgaaccgtccgaaggtagcgcaccaggttctagcccttctgcatctactggtactggcccaggtagctctactccttctggtgctaccggctctccaggtgcttctccgggtactagctctaccggttctccaggtacttctactccggaaagcggttccgcatctccaggtacttctcctagcggtgaatcttctactgctccaggtacctctcctagcggcgaatcttctactgctcca

SEQ ID NO: 609 - DNA, 432 bp, Artificial Sequence
  Description of Artificial Sequence: Synthetic polynucleotide
ggtacctctgaaagcgctactccggagtctggcccaggtacctctactgaaccgtctgagggtagcgctccaggtacttctactgaaccgtccgaaggtagcgcaccaggtagccctgctggctctccgacttctactgaggaaggtagcccggctggttctccgacttctactgaggaaggtacttctaccgaaccttccgaaggtagcgctccaggttctagcccttctgcttccaccggtactggcccaggtagctctaccccttctggtgctaccggctccccaggtagctctactccttctggtgcaactggctctccaggtagcgaaccggcaacttccggctctgaaaccccaggtacttctgaaagcgctactcctgagtctggcccaggtagcgaacctgctacctctggctctgaaacccca

SEQ ID NO: 610 - DNA, 432 bp, Artificial Sequence
  Description of Artificial Sequence: Synthetic polynucleotide
ggtacttctaccgaaccgtccgaaggcagcgctccaggtacctctactgaaccttccgagggcagcgctccaggtacctctaccgaaccttctgaaggtagcgcaccaggtagctctaccccgtctggtgctaccggttccccaggtgcttctcctggtactagctctaccggttctccaggtagctctaccccgtctggtgctactggctctccaggtacttctgaaagcgcaacccctgaatccggtccaggtagcgaaccggctacttctggctctgagactccaggtacttctaccgaaccgtccgaaggtagcgcaccaggttctactagcgaatctccttctggcactgcaccaggttctaccagcgaatctccgtctggcactgcaccaggtacctctacccctgaaagcggttccgcttctcca

SEQ ID NO: 611 - DNA, 432 bp, Artificial Sequence
  Description of Artificial Sequence: Synthetic polynucleotide
ggtacctctactcctgaaagcggttctgcatctccaggttccactagctctaccgcagaatctccgggcccaggttctactagctctactgctgaatctcctggcccaggttctagcccttctgcatctactggtactggcccaggtagctctactccttctggtgctaccggctctccaggtgcttctccgggtactagctctaccggttctccaggtagcgaaccggcaacctccggctctgaaaccccaggtacctctgaaagcgctactcctgaatccggcccaggtagcccggcaggttctccgacttccactgaggaaggttctactagcgaatctccttctggcactgcaccaggttctaccagcgaatctccgtctggcactgcaccaggtacctctacccctgaaagcggttccgcttctccc

SEQ ID NO: 612 - DNA, 432 bp, Artificial Sequence
  Description of Artificial Sequence: Synthetic polynucleotide
ggtagcccggctggctctcctacctctactgaggaaggtacttctgaaagcgctactcctgagtctggtccaggtacctctactgaaccgtccgaaggtagcgctccaggttctaccagcgaatctccttctggcaccgctccaggttctactagcgaatccccgtctggtaccgcaccaggtacttctcctagcggcgaatcttctaccgcaccaggtacctctaccgaaccttccgaaggtagcgctccaggtagcccggcaggttctcctacttccactgaggaaggtacttctaccgaaccttctgagggtagcgcaccaggtagcgaacctgcaacctctggctctgaaaccccaggtacctctgaaagcgctactcctgaatctggcccaggtacttctactgaaccgtccgagggcagcgcacca

SEQ ID NO: 613 - DNA, 432 bp, Artificial Sequence
  Description of Artificial Sequence: Synthetic polynucleotide
ggtacctctaccgaaccttccgaaggtagcgctccaggtagcccggcaggttctcctacttccactgaggaaggtacttctaccgaaccttctgagggtagcgcaccaggtacctcccctagcggcgaatcttctactgctccaggtacctctcctagcggcgaatcttctaccgctccaggtacctcccctagcggtgaatcttctaccgcaccaggttctaccagcgaatccccttctggtactgctccaggttctaccagcgaatccccttctggcaccgcaccaggtacttctacccctgaaagcggctccgcttctccaggtagcgaacctgcaacctctggctctgaaaccccaggtacctctgaaagcgctactcctgaatctggcccaggtacttctactgaaccgtccgagggcagcgcacca

SEQ ID NO: 614 - DNA, 432 bp, Artificial Sequence
  Description of Artificial Sequence: Synthetic polynucleotide
ggtagcgaaccggcaacctctggctctgaaaccccaggtacctctgaaagcgctactccggaatctggtccaggtacttctgaaagcgctactccggaatccggtccaggtacttctccgagcggtgaatcttctaccgcaccaggttctactagctctaccgctgaatctccgggcccaggtacttctccgagcggtgaatcttctactgctccaggttctactagcgaatccccgtctggtactgctccaggtacttcccctagcggtgaatcttctactgctccaggttctaccagctctaccgcagaatctccgggtccaggtagctctactccgtctggtgcaaccggttccccaggtagctctaccccttctggtgcaaccggctccccaggtagctctaccccttctggtgcaaactggctctcc

SEQ ID NO: 615 - DNA, 432 bp, Artificial Sequence
  Description of Artificial Sequence: Synthetic polynucleotide
ggtagccctgctggctctccgacttctactgaggaaggtagcccggctggttctccgacttctactgaggaaggtacttctaccgaaccttccgaaggtagcgctccaggtacctctactgaaccttccgaaggcagcgctccaggtacctctaccgaaccgtccgagggcagcgcaccaggtacttctgaaagcgcaacccctgaatccggtccaggtgcatctcctggtaccagctctaccggttctccaggtagctctactccttctggtgctactggctctccaggtgcttccccgggtaccagctctaccggttctccaggtagctctaccccgtctggtgctactggttctccaggtactccgggcagcggtactgcttcttcctctccaggtagctctaccccttctggtgctactggctctcca

SEQ ID NO: 616 - DNA, 432 bp, Artificial Sequence
  Description of Artificial Sequence: Synthetic polynucleotide
ggtagctctaccccgtctggtgctactggttctccaggtactccgggcagcggtactgcttcttcctctccaggtagctctaccccttctggtgctactggctctccaggtagcccggctggctctcctacctctactgaggaaggtacttctgaaagcgctactcctgagtctggtccaggtacctctactgaaccgtccgaaggtagcgctccaggtacctctgaaagcgcaactcctgagtctggcccaggtagcgaacctgctacctccggctctgagactccaggtacctctgaaagcgcaaccccggaatctggtccaggtacttctactgaaccgtctgaaggtagcgcaccaggtacttctgaaagcgcaaccccggaatccggcccaggtacctctgaaagcgcaaccccggagtccggccca

SEQ ID NO: 617 - protein, 144 aa, Artificial Sequence
  Description of Artificial Sequence: Synthetic polypeptide
GTPGSGTASSSPGSSTPSGATGSPGSSTPSGATGSPGSPAGSPTSTEEGTSESATPESGPGTSTEPSEGSAPGSSPSASTGTGPGSSPSASTGTGPGASPGTSSTGSPGTSTEPSEGSAPGTSTEPSEGSAPGSEPATSGSETP

SEQ ID NO: 618 - protein, 144 aa, Artificial Sequence
  Description of Artificial Sequence: Synthetic polypeptide
GSTSESPSGTAPGSTSESPSGTAPGTSPSGESSTAPGTSTEPSEGSAPGTSTEPSEGSAPGTSESATPESGPGASPGTSSTGSPGSSTPSGATGSPGASPGTSSTGSPGSTSESPSGTAPGSTSESPSGTAPGTSTPESGSASP

SEQ ID NO: 619 - protein, 144 aa, Artificial Sequence
  Description of Artificial Sequence: Synthetic polypeptide
GTSTEPSEGSAPGTSESATPESGPGTSESATPESGPGTSTEPSEGSAPGTSESATPESGPGTSTEPSEGSAPGTSTEPSEGSAPGSEPATSGSETPGSPAGSPTSTEEGASPGTSSTGSPGSSPSASTGTGPGSSPSASTGTGP

SEQ ID NO: 620 - protein, 144 aa, Artificial Sequence
  Description of Artificial Sequence: Synthetic polypeptide
GSEPATSGSETPGTSESATPESGPGTSESATPESGPGSTSESPSGTAPGSTSESPSGTAPGTSPSGESSTAPGASPGTSSTGSPGSSPSASTGTGPGSSTPSGATGSPGSSTPSGATGSPGSSTPSGATGSPGASPGTSSTGSP

SEQ ID NO: 621 - protein, 144 aa, Artificial Sequence
  Description of Artificial Sequence: Synthetic polypeptide
GASPGTSSTGSPGSSPSASTGTGPGSSTPSGATGSPGTSESATPESGPGSEPATSGSETPGSEPATSGSETPGTSESATPESGPGTSTEPSEGSAPGTSTEPSEGSAPGTSTEPSEGSAPGTSTEPSEGSAPGSEPATSGSETP

SEQ ID NO: 622 - protein, 144 aa, Artificial Sequence
  Description of Artificial Sequence: Synthetic polypeptide
GTSTEPSEGSAPGSPAGSPTSTEEGTSTEPSEGSAPGTSESATPESGPGSEPATSGSETPGTSESATPESGPGSPAGSPTSTEEGTSESATPESGPGTSTEPSEGSAPGSEPATSGSETPGTSTEPSEGSAPGSEPATSGSETP

SEQ ID NO: 623 - protein, 144 aa, Artificial Sequence
  Description of Artificial Sequence: Synthetic polypeptide
GTSTEPSEGSAPGTSTEPSEGSAPGTSTEPSEGSAPGTSTEPSEGSAPGTSTEPSEGSAPGTSTEPSEGSAPGTSTEPSEGSAPGTSESATPESGPGTSESATPESGPGTSTEPSEGSAPGSEPATSGSETPGSPAGSPTSTEE

SEQ ID NO: 624 - protein, 144 aa, Artificial Sequence
  Description of Artificial Sequence: Synthetic polypeptide
GTSTEPSEGSAPGTSTEPSEGSAPGTSTEPSEGSAPGSTSESPSGTAPGSTSESPSGTAPGTSTPESGSASPGSEPATSGSETPGTSESATPESGPGTSTEPSEGSAPGTSTEPSEGSAPGTSESATPESGPGTSESATPESGP

SEQ ID NO: 625 - protein, 144 aa, Artificial Sequence
  Description of Artificial Sequence: Synthetic polypeptide
GSSTPSGATGSPGSSPSASTGTGPGSSTPSGATGSPGSPAGSPTSTEEGSPAGSPTSTEEGTSTEPSEGSAPGASPGTSSTGSPGSSPSASTGTGPGTPGSGTASSSPGSTSSTAESPGPGTSPSGESSTAPGTSTPESGSASP

SEQ ID NO: 626 - protein, 144 aa, Artificial Sequence
  Description of Artificial Sequence: Synthetic polypeptide
GTSTEPSEGSAPGTSESATPESGPGTSTEPSEGSAPGTSTEPSEGSAPGTSESATPESGPGTSESATPESGPGTPGSGTASSSPGASPGTSSTGSPGASPGTSSTGSPGSPAGSPTSTEEGSPAGSPTSTEEGTSTEPSEGSAP

SEQ ID NO: 627 - protein, 144 aa, Artificial Sequence
  Description of Artificial Sequence: Synthetic polypeptide
GSPAGSPTSTEEGTSTEPSEGSAPGTSTEPSEGSAPGTSTEPSEGSAPGTSESATPESGPGTSESATPESGPGTPGSGTASSSPGSSTPSGATGSPGASPGTSSTGSPGTSTEPSEGSAPGTSESATPESGPGTSTEPSEGSAP

SEQ ID NO: 628 - protein, 144 aa, Artificial Sequence
  Description of Artificial Sequence: Synthetic polypeptide
GSEPATSGSETPGTSESATPESGPGSEPATSGSETPGSSTPSGATGSPGTPGSGTASSSPGSSTPSGATGSPGASPGTSSTGSPGSSTPSGATGSPGASPGTSSTGSPGSEPATSGSETPGTSTEPSEGSAPGSEPATSGSETP

SEQ ID NO: 629 - protein, 144 aa, Artificial Sequence
  Description of Artificial Sequence: Synthetic polypeptide
GTSTEPSEGSAPGTSTEPSEGSAPGTSESATPESGPGSPAGSPTSTEEGSPAGSPTSTEEGTSTEPSEGSAPGSPAGSPTSTEEGTSTEPSEGSAPGTSTEPSEGSAPGASPGTSSTGSPGSSPSASTGTGPGSSPSASTGTGP

SEQ ID NO: 630 - protein, 144 aa, Artificial Sequence
  Description of Artificial Sequence: Synthetic polypeptide
GSSTPSGATGSPGASPGTSSTGSPGSSTPSGATGSPGSPAGSPTSTEEGTSESATPESGPGSEPATSGSETPGASPGTSSTGSPGSSTPSGATGSPGSSPSASTGTGPGSTSESPSGTAPGSTSESPSGTAPGTSTPESGSASP

SEQ ID NO: 631 - protein, 144 aa, Artificial Sequence
  Description of Artificial Sequence: Synthetic polypeptide
GSTSESPSGTAPGSTSESPSGTAPGTSPSGESSTAPGTSESATPESGPGTSTEPSEGSAPGTSTEPSEGSAPGTSTEPSEGSAPGTSESATPESGPGTSTEPSEGSAPGSSTPSGATGSPGASPGTSSTGSPGSSTPSGATGSP

SEQ ID NO: 632 - protein, 144 aa, Artificial Sequence
  Description of Artificial Sequence: Synthetic polypeptide
GSTSSTAESPGPGTSPSGESSTAPGTSPSGESSTAPGSTSSTAESPGPGSTSSTAESPGPGTSTPESGSASPGTSPSGESSTAPGSTSSTAESPGPGTSTPESGSASPGSTSSTAESPGPGSTSESPSGTAPGTSPSGESSTAP

SEQ ID NO: 633 - protein, 144 aa, Artificial Sequence
  Description of Artificial Sequence: Synthetic polypeptide
GTSTPESGSASPGSTSESPSGTAPGSTSSTAESPGPGTSTEPSEGSAPGTSTEPSEGSAPGTSESATPESGPGTSESATPESGPGTSTEPSEGSAPGTSTEPSEGSAPGTSESATPESGPGTSTEPSEGSAPGTSTEPSEGSAP

SEQ ID NO: 634 - protein, 144 aa, Artificial Sequence
  Description of Artificial Sequence: Synthetic polypeptide
GTSTEPSEGSAPGTSTEPSEGSAPGSEPATSGSETPGTSTEPSEGSAPGTSESATPESGPGTSESATPESGPGASPGTSSTGSPGSSPSASTGTGPGSSTPSGATGSPGSSTPSGATGSPGSSTPSGATGSPGASPGTSSTGSP

SEQ ID NO: 635 - protein, 144 aa, Artificial Sequence
  Description of Artificial Sequence: Synthetic polypeptide
GSEPATSGSETPGSEPATSGSETPGTSTEPSEGSAPGSEPATSGSETPGTSESATPESGPGTSTEPSEGSAPGSSTPSGATGSPGSSTPSGATGSPGASPGTSSTGSPGSSTPSGATGSPGASPGTSSTGSPGSSTPSGATGSP

SEQ ID NO: 636 - protein, 144 aa, Artificial Sequence
  Description of Artificial Sequence: Synthetic polypeptide
GTSTEPSEGSAPGTSTEPSEGSAPGTSTEPSEGSAPGTSESATPESGPGTSTEPSEGSAPGTSTEPSEGSAPGSTSESPSGTAPGTSPSGESSTAPGTSPSGESSTAPGSPAGSPTSTEEGTSESATPESGPGTSTEPSEGSAP

SEQ ID NO: 637 - protein, 144 aa, Artificial Sequence
  Description of Artificial Sequence: Synthetic polypeptide
GTSTEPSEGSAPGSEPATSGSETPGSPAGSPTSTEEGSPAGSPTSTEEGTSESATPESGPGTSTEPSEGSAPGTSTEPSEGSAPGTSTEPSEGSAPGTSESATPESGPGSSTPSGATGSPGSSPSASTGTGPGASPGTSSTGSP

SEQ ID NO: 638 - protein, 144 aa, Artificial Sequence
  Description of Artificial Sequence: Synthetic polypeptide
GSEPATSGSETPGSPAGSPTSTEEGTSESATPESGPGTSTEPSEGSAPGTSTEPSEGSAPGTSESATPESGPGTSTPESGSASPGSTSESPSGTAPGSTSSTAESPGPGTSESATPESGPGTSTEPSEGSAPGTSTEPSEGSAP

SEQ ID NO: 639 - protein, 144 aa, Artificial Sequence
  Description of Artificial Sequence: Synthetic polypeptide
GTSTEPSEGSAPGTSTEPSEGSAPGTSTEPSEGSAPGTSTEPSEGSAPGTSESATPESGPGTSESATPESGPGTPGSGTASSSPGSSTPSGATGSPGASPGTSSTGSPGSTSSTAESPGPGTSPSGESSTAPGTSTPESGSASP

SEQ ID NO: 640 - protein, 144 aa, Artificial Sequence
  Description of Artificial Sequence: Synthetic polypeptide
GSPAGSPTSTEEGTSESATPESGPGTSTEPSEGSAPGTSESATPESGPGSEPATSGSETPGTSTEPSEGSAPGSPAGSPTSTEEGTSTEPSEGSAPGTSTEPSEGSAPGTSTEPSEGSAPGTSTEPSEGSAPGTSTEPSEGSAP

SEQ ID NO: 641 - protein, 144 aa, Artificial Sequence
  Description of Artificial Sequence: Synthetic polypeptide
GTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAP

SEQ ID NO: 642 - protein, 144 aa, Artificial Sequence
  Description of Artificial Sequence: Synthetic polypeptide
GTSESATPESGPGTSTEPSEGSAPGTSTEPSEGSAPGSPAGSPTSTEEGSPAGSPTSTEEGTSTEPSEGSAPGSSPSASTGTGPGSSTPSGATGSPGSSTPSGATGSPGSEPATSGSETPGTSESATPESGPGSEPATSGSETP

SEQ ID NO: 643 - protein, 144 aa, Artificial Sequence
  Description of Artificial Sequence: Synthetic polypeptide
GTSTEPSEGSAPGTSTEPSEGSAPGTSTEPSEGSAPGSSTPSGATGSPGASPGTSSTGSPGSSTPSGATGSPGTSESATPESGPGSEPATSGSETPGTSTEPSEGSAPGSTSESPSGTAPGSTSESPSGTAPGTSTPESGSASP

SEQ ID NO: 644 - protein, 144 aa, Artificial Sequence
  Description of Artificial Sequence: Synthetic polypeptide
GTSTPESGSASPGSTSSTAESPGPGSTSSTAESPGPGSSPSASTGTGPGSSTPSGATGSPGASPGTSSTGSPGSEPATSGSETPGTSESATPESGPGSPAGSPTSTEEGSTSESPSGTAPGSTSESPSGTAPGTSTPESGSASP

SEQ ID NO: 645 - protein, 144 aa, Artificial Sequence
  Description of Artificial Sequence: Synthetic polypeptide
GSPAGSPTSTEEGTSESATPESGPGTSTEPSEGSAPGSTSESPSGTAPGSTSESPSGTAPGTSPSGESSTAPGTSTEPSEGSAPGSPAGSPTSTEEGTSTEPSEGSAPGSEPATSGSETPGTSESATPESGPGTSTEPSEGSAP

SEQ ID NO: 646 - protein, 144 aa, Artificial Sequence
  Description of Artificial Sequence: Synthetic polypeptide
GTSTEPSEGSAPGSPAGSPTSTEEGTSTEPSEGSAPGTSPSGESSTAPGTSPSGESSTAPGTSPSGESSTAPGSTSESPSGTAPGSTSESPSGTAPGTSTPESGSASPGSEPATSGSETPGTSESATPESGPGTSTEPSEGSAP

SEQ ID NO: 647 - protein, 144 aa, Artificial Sequence
  Description of Artificial Sequence: Synthetic polypeptide
GSEPATSGSETPGTSESATPESGPGTSESATPESGPGTSPSGESSTAPGSTSSTAESPGPGTSPSGESSTAPGSTSESPSGTAPGTSPSGESSTAPGSTSSTAESPGPGSSTPSGATGSPGSSTPSGATGSPGSSTPSGANWLS

SEQ ID NO: 648 - protein, 144 aa, Artificial Sequence
  Description of Artificial Sequence: Synthetic polypeptide
GSPAGSPTSTEEGSPAGSPTSTEEGTSTEPSEGSAPGTSTEPSEGSAPGTSTEPSEGSAPGTSESATPESGPGASPGTSSTGSPGSSTPSGATGSPGASPGTSSTGSPGSSTPSGATGSPGTPGSGTASSSPGSSTPSGATGSP

SEQ ID NO: 649 - protein, 144 aa, Artificial Sequence
  Description of Artificial Sequence: Synthetic polypeptide
GSSTPSGATGSPGTPGSGTASSSPGSSTPSGATGSPGSPAGSPTSTEEGTSESATPESGPGTSTEPSEGSAPGTSESATPESGPGSEPATSGSETPGTSESATPESGPGTSTEPSEGSAPGTSESATPESGPGTSESATPESGP

SEQ ID NO: 650 - DNA, 57 bp, Artificial Sequence
  Description of Artificial Sequence: Synthetic oligonucleotide
aggtgcaagcgcaagcggcgcgccaagcacgggaggttcgtcttcactcgagggtac

SEQ ID NO: 651 - DNA, 49 bp, Artificial Sequence
  Description of Artificial Sequence: Synthetic oligonucleotide
cctcgagtgaagacgaacctcccgtgcttggcgcgccgcttgcgcttgc

SEQ ID NO: 652 - protein, 11 aa, Artificial Sequence
  Description of Artificial Sequence: Synthetic peptide
GASASGAPSTG

SEQ ID NO: 653 - DNA, 57 bp, Artificial Sequence
  Description of Artificial Sequence: Synthetic oligonucleotide
aggtccagaaccaacggggccggccccaagcggaggttcgtcttcactcgagggtac

SEQ ID NO: 654 - DNA, 49 bp, Artificial Sequence
  Description of Artificial Sequence: Synthetic oligonucleotide
cctcgagtgaagacgaacctccgcttggggccggccccgttggttctgg

SEQ ID NO: 655 - protein, 11 aa, Artificial Sequence
  Description of Artificial Sequence: Synthetic peptide
GPEPTGPAPSG

SEQ ID NO: 656 - protein, 13 aa, Artificial Sequence
  Description of Artificial Sequence: Synthetic peptide
MASPAGSPTSTEE

SEQ ID NO: 657 - protein, 13 aa, Artificial Sequence
  Description of Artificial Sequence: Synthetic peptide
MATSESATPESGP

SEQ ID NO: 658 - protein, 13 aa, Artificial Sequence
  Description of Artificial Sequence: Synthetic peptide
MATSPSGESSTAP

SEQ ID NO: 659 - protein, 13 aa, Artificial Sequence
  Description of Artificial Sequence: Synthetic peptide
MESTSSTAESPGP

SEQ ID NO: 660 - protein, 13 aa, Artificial Sequence
  Description of Artificial Sequence: Synthetic peptide
MASSTPSGATGSP

SEQ ID NO: 661 - protein, 13 aa, Artificial Sequence
  Description of Artificial Sequence: Synthetic peptide
MEASPGTSSTGSP

SEQ ID NO: 662 - protein, 11 aa, Artificial Sequence
  Description of Artificial Sequence: Synthetic peptide
MASTPESGSSG

SEQ ID NO: 663 - DNA, 51 bp, Artificial Sequence
  Description of Artificial Sequence: Synthetic oligonucleotide
atggctagtccggctggctctccgacctccactgaggaaggtacttctact

SEQ ID NO: 664 - DNA, 51 bp, Artificial Sequence
  Description of Artificial Sequence: Synthetic oligonucleotide
atggctagtcctgctggctctccaacctccactgaggaaggtacttctact

SEQ ID NO: 665 - DNA, 51 bp, Artificial Sequence
  Description of Artificial Sequence: Synthetic oligonucleotide
atggctagtccagcaggctctcctacctccaccgaggaaggtacttctact

SEQ ID NO: 666 - DNA, 51 bp, Artificial Sequence
  Description of Artificial Sequence: Synthetic oligonucleotide
atggctagtcctgctggctctccgacctctactgaggaaggtacttctact

SEQ ID NO: 667 - DNA, 51 bp, Artificial Sequence
  Description of Artificial Sequence: Synthetic oligonucleotide
atggctacatccgaaagcgcaacccctgagtccggtccaggtacttctact

SEQ ID NO: 668 - DNA, 51 bp, Artificial Sequence
  Description of Artificial Sequence: Synthetic oligonucleotide
atggctacatccgaaagcgcaacccctgaatctggtccaggtacttctact

SEQ ID NO: 669 - DNA, 51 bp, Artificial Sequence
  Description of Artificial Sequence: Synthetic oligonucleotide
atggctacgtctgaaagcgctactccggaatctggtccaggtacttctact

SEQ ID NO: 670 - DNA, 51 bp, Artificial Sequence
  Description of Artificial Sequence: Synthetic oligonucleotide
atggctacgtccgaaagcgctacccctgaatccggtccaggtacttctact

SEQ ID NO: 671 - DNA, 51 bp, Artificial Sequence
  Description of Artificial Sequence: Synthetic oligonucleotide
atggctagttctaccccgtctggtgcaaccggttccccaggtacttctact

SEQ ID NO: 672 - DNA, 51 bp, Artificial Sequence
  Description of Artificial Sequence: Synthetic oligonucleotide
atggctagctccactccgtctggtgctaccggttccccaggtacttctact

SEQ ID NO: 673 - DNA, 51 bp, Artificial Sequence
  Description of Artificial Sequence: Synthetic oligonucleotide
atggctagctctactccgtctggtgctactggttccccaggtacttctact

SEQ ID NO: 674 - DNA, 51 bp, Artificial Sequence
  Description of Artificial Sequence: Synthetic oligonucleotide
atggctagttctaccccttctggtgctactggttctccaggtacttctact

SEQ ID NO: 675 - DNA, 180 bp, Artificial Sequence
  Description of Artificial Sequence: Synthetic polynucleotide
atggctagtcctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgca

SEQ ID NO: 676 - DNA, 180 bp, Artificial Sequence; identical to SEQ ID NO: 675
  Description of Artificial Sequence: Synthetic polynucleotide

SEQ ID NO: 677 - DNA, 180 bp, Artificial Sequence
  Description of Artificial Sequence: Synthetic polynucleotide
atggctagtcctgctggctctccaacctccactgaggaaggtacttctaccgaaccgtccgagggtagcgcaccaggtagcccagcaggttctcctacctccaccgaggaaggtacttctaccgaaccgtccgagggtagcgcaccaggtacttctactgaaccgtctgaaggcagcgca

SEQ ID NO: 678 - DNA, 180 bp, Artificial Sequence
  Description of Artificial Sequence: Synthetic polynucleotide
atggctagtcctgctggctctccgacctctactgaggaaggtacttctactgaaccgtctgaaggcagcgcaccaggtagcgaaccggctacttccggttctgaaaccccaggtagcccagcaggttctccaacttctactgaagaaggtacttctactgaaccgtctgaaggcagcgca

SEQ ID NO: 679 - DNA, 180 bp, Artificial Sequence
  Description of Artificial Sequence: Synthetic polynucleotide
atggctagtcctgctggctctccaacctccactgaggaaggtaccccgggtagcggtactgcttcttcctctccaggtagctctaccccttctggtgcaaccggctctccaggtgcttctccgggcaccagctctaccggttctccaggtacttctactgaaccgtctgaaggcagcgca

SEQ ID NO: 680 - DNA, 180 bp, Artificial Sequence; identical to SEQ ID NO: 678
  Description of Artificial Sequence: Synthetic polynucleotide

SEQ ID NO: 681 - DNA, 180 bp, Artificial Sequence
  Description of Artificial Sequence: Synthetic polynucleotide
atggctagtcctgctggctctccgacctctactgaggaaggtacctcccctagcggcgaatcttctactgctccaggtacctctcctagcggcgaatcttctaccgctccaggtacctcccctagcggtgaatcttctaccgcaccaggtacttctactgaaccgtctgaaggcagcgca

SEQ ID NO: 682 - DNA, 180 bp, Artificial Sequence
  Description of Artificial Sequence: Synthetic polynucleotide
atggctagtcctgctggctctccgacctctactgaggaaggtacctctactccggaaagcggttccgcatctccaggttctaccagcgaatccccgtctggcaccgcaccaggttctactagctctactgctgaatctccgggcccaggtacttctactgaaccgtctgaaggcagcgca

SEQ ID NO: 683 - DNA, 180 bp, Artificial Sequence; identical to SEQ ID NO: 681
  Description of Artificial Sequence: Synthetic polynucleotide

SEQ ID NO: 684 - DNA, 180 bp, Artificial Sequence; identical to SEQ ID NO: 682
  Description of Artificial Sequence: Synthetic polynucleotide

SEQ ID NO: 685 - DNA, 180 bp, Artificial Sequence
  Description of Artificial Sequence: Synthetic polynucleotide
atggctgaacctgctggctctccaacctccactgaggaaggtgcatccccgggcaccagctctaccggttctccaggtagctctaccccgtctggtgctaccggctctccaggtagctctaccccgtctggtgctactggctctccaggtacttctactgaaccgtctgaaggcagcgca

SEQ ID NO: 686 - DNA, 180 bp, Artificial Sequence
  Description of Artificial Sequence: Synthetic polynucleotide
atggctgaacctgctggctctccgacctctactgaggaaggtacctcccctagcggcgaatcttctactgctccaggtacctctcctagcggcgaatcttctaccgctccaggtacctcccctagcggtgaatcttctaccgcaccaggtacttctactgaaccgtctgaaggcagcgca

SEQ ID NO: 687 - DNA, 180 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgag

SEQ ID NO: 688 - DNA, 180 bp, Artificial Sequence
  Description of Artificial Sequence: Synthetic polynucleotide
atggctgaaactgctggctctccaacctccactgaggaaggtgcatccccgggcaccagctctaccggttctccaggtagctctaccccgtctggtgctaccggctctccaggtagctctaccccgtctggtgctactggctctccaggtagcccggctggctctcctacctctactgag

SEQ ID NO: 689 - DNA, 40 bp, Artificial Sequence
  Description of Artificial Sequence: Synthetic primer
ataaagggtctccaggtgaaattgttctgacccaatctcc

SEQ ID NO: 690 - DNA, 41 bp, Artificial Sequence
  Description of Artificial Sequence: Synthetic primer
ataaagggtctccaggtgaaattgttctgactcaatctcca

SEQ ID NO: 691 - DNA, 36 bp, Artificial Sequence
  Description of Artificial Sequence: Synthetic primer
aactcgaagcttttagctagacacagtaaccagagt

SEQ ID NO: 692 - DNA, 36 bp, Artificial Sequence
  Description of Artificial Sequence: Synthetic primer
aactcgaagcttttaagaggatacggtcaccagagt

SEQ ID NO: 693 - DNA, 37 bp, Artificial Sequence
  Description of Artificial Sequence: Synthetic primer
agatatacatatggaagacattcagatgacccagagc

SEQ ID NO: 694 - DNA, 40 bp, Artificial Sequence
  Description of Artificial Sequence: Synthetic primer
ccgggctacctggagacccggaaacagttaccagagtacc

SEQ ID NO: 695 - DNA, 42 bp, Artificial Sequence
  Description of Artificial Sequence: Synthetic primer
gcaccaggttcgtcttcactcgacattcagatgacccagagc

SEQ ID NO: 696 - DNA, 39 bp, Artificial Sequence
  Description of Artificial Sequence: Synthetic primer
aactcgaagctttcaggaaacagttaccagagtaccttg

SEQ ID NO: 697 - protein, 8 aa, Artificial Sequence
  Description of Artificial Sequence: Synthetic 8xHis tag
HHHHHHHH

SEQ ID NO: 698 - DNA, 3441 bp, Artificial Sequence
  Description of Artificial Sequence: Synthetic polynucleotide
atggcaatgcatgttgcacagcctgcagttgttctggcaagcagccgtggtattgccagctttgtttgtgaatatgcaagtccgggtaaagcaaccgaagttcgtgttaccgttctgagacaggcagatagccaggttaccgaagtttgtgcagcaacctatatgatgggtaatgaactgacctttctggatgatagcatttgtaccggcaccagcagcggtaatcaggttaatctgaccattcagggtctgcgtgcaatggataccggtctgtatatttgtaaagtggaactgatgtatccgcctccgtattatctgggtattggtaatggcacccagatttatgttattgatccggaaggcgcgccaggtacaagcgaaagcgcaacaccggaaagcggtccgggtagcgaaccggcaaccagcggtagcgaaacaccgggtacatcaaccgaaccgagcgaaggtagcgcaccggggccggccatgcatgtggcccagccagccgtggtgctggcaagttcacgcggtattgcatcatttgtgtgcgaatatgcatcacctggtaaagccacagaagtgcgcgtaacagtactgcgtcaggccgattcacaggtgacagaagtttgcgctgccacatacatgatgggcaacgagctgacattcctggacgattcaatttgtactggtacaagctcaggcaatcaggtgaacctgacaatccaaggcctgagagctatggacacaggcctgtacatctgcaaagttgagctgatgtaccctccgccttattacttaggcattggcaacggtacacagatctatgtgatcgatcctgagggaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggttaa

SEQ ID NO: 699 - DNA, 3471 bp, Artificial Sequence
  Description of Artificial Sequence: Synthetic polynucleotide
atggcaatgcatgttgcacagcctgcagttgttctggcaagcagccgtggtattgccagctttgtttgtgaatatgcaagtccgggtaaagcaaccgaagttcgtgttaccgttctgagacaggcagatagccaggttaccgaagtttgtgcagcaacctatatgatgggtaatgaactgacctttctggatgatagcatttgtaccggcaccagcagcggtaatcaggttaatctgaccattcagggtctgcgtgcaatggataccggtctgtatatttgtaaagtggaactgatgtatccgcctccgtattatctgggtattggtaatggcacccagatttatgttattgatccggaaccgtgtccggatagcggcgcgccaggtacaagcgaaagcgcaacaccggaaagcggtccgggtagcgaaccggcaaccagcggtagcgaaacaccgggtacatcaaccgaaccgagcgaaggtagcgcaccggggccggccatgcatgtggcccagccagccgtggtgctggcaagttcacgcggtattgcatcatttgtgtgcgaatatgcatcacctggtaaagccacagaagtgcgcgtaacagtactgcgtcaggccgattcacaggtgacagaagtttgcgctgccacatacatgatgggcaacgagctgacattcctggacgattcaatttgtactggtacaagctcaggcaatcaggtgaacctgacaatccaaggcctgagagctatggacacaggcctgtacatctgcaaagttgagctgatgtaccctccgccttattacttaggcattggcaacggtacacagatctatgtgatcgatcctgaaccttgccctgattcaggaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggttaa

SEQ ID NO: 700 - DNA, 3789 bp, Artificial Sequence
  Description of Artificial Sequence: Synthetic polynucleotide
atggcaatgcatgttgcacagcctgcagttgttctggcaagcagccgtggtattgccagctttgtttgtgaatatgcaagtccgggtaaagcaaccgaagttcgtgttaccgttctgagacaggcagatagccaggttaccgaagtttgtgcagcaacctatatgatgggtaatgaactgacctttctggatgatagcatttgtaccggcaccagcagcggtaatcaggttaatctgaccattcagggtctgcgtgcaatggataccggtctgtatatttgtaaagtggaactgatgtatccgcctccgtattatctgggtattggtaatggcacccagatttatgttattgatccggaaggcgcgccaagcacgggaggtacttctgaaagcgctactccggagtccggtccaggtacctctaccgaaccgtccgaaggcagcgctccaggtacttctactgaaccttctgagggtagcgctccaggtacttctgaaagcgctactccggagtccggtccaggtacctctaccgaaccgtccgaaggcagcgctccaggtacttctactgaaccttctgagggtagcgctccaggtacctctgaaagcgctactccggagtctggcccaggtacctctactgaaccgtctgagggtagcgctccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtccagaaccaacggggccggccatgcatgtggcccagccagccgtggtgctggcaagttcacgcggtattgcatcatttgtgtgcgaatatgcatcacctggtaaagccacagaagtgcgcgtaacagtactgcgtcaggccgattcacaggtgacagaagtttgcgctgccacatacatgatgggcaacgagctgacattcctggacgattcaatttgtactggtacaagctcaggcaatcaggtgaacctgacaatccaaggcctgagagctatggacacaggcctgtacatctgcaaagttgagctgatgtaccctccgccttattacttaggcattggcaacggtacacagatctatgtgatcgatcctgagggaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggttaa

SEQ ID NO: 701 - DNA, 3819 bp, Artificial Sequence
  Description of Artificial Sequence: Synthetic polynucleotide
atggcaatgcatgttgcacagcctgcagttgttctggcaagcagccgtggtattgccagctttgtttgtgaatatgcaagtccgggtaaagcaaccgaagttcgtgttaccgttctgagacaggcagatagccaggttaccgaagtttgtgcagcaacctatatgatgggtaatgaactgacctttctggatgatagcatttgtaccggcaccagcagcggtaatcaggttaatctgaccattcagggtctgcgtgcaatggataccggtctgtatatttgtaaagtggaactgatgtatccgcctccgtattatctgggtattggtaatggcacccagatttatgttattgatccggaaccgtgtccggatagcggcgcgccaagcacgggaggtacttctgaaagcgctactccggagtccggtccaggtacctctaccgaaccgtccgaaggcagcgctccaggtacttctactgaaccttctgagggtagcgctccaggtacttctgaaagcgctactccggagtccggtccaggtacctctaccgaaccgtccgaaggcagcgctccaggtacttctactgaaccttctgagggtagcgctccaggtacctctgaaagcgctactccggagtctggcccaggtacctctactgaaccgtctgagggtagcgctccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggtccagaaccaacggggccggccatgcatgtggcccagccagccgtggtgctggcaagttcacgcggtattgcatcatttgtgtgcgaatatgcatcacctggtaaagccacagaagtgcgcgtaacagtactgcgtcaggccgattcacaggtgacagaagtttgcgctgccacatacatgatgggcaacgagctgacattcctggacgattcaatttgtactggtacaagctcaggcaatcaggtgaacctgacaatccaaggcctgagagctatggacacaggcctgtacatctgcaaagttgagctgatgtaccctccgccttattacttaggcattggcaacggtacacagatctatgtgatcgatcctgaaccttgccctgattcaggaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggttaa

SEQ ID NO: 702 - DNA, 3522 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtgctgatattcaaatgactcaatctccttcttctctgtccgcatctgtaggcgaccgtgtaaccatcacttgccgtgcctcccaggacatctccagctacctgaactggtaccagcagaagccgggcaaggctccgaaactgctgatttattacactagccgtctgcattctggtgttccgagccgcttctccggttctggcagcggtaccgatttcacttttactatctccagcctgcaaccggaggacatcgcgacgtactattgccagcaaggtaataccctgccgtacaccttcggccaaggcacgaaagttgaaatcaaaaccggttctggcgaaggctctgaaggtgaaggtggtggtgaaggctctgaaggtgaaggatctggtgaaggtggcgaaggtgagggttctggatcccaagttcagctgcaggaatctggtccgggtctggttcgtccgtctcagaccctgtccctgacctgcacggtgtccggctactctattacctctgaccatgcgtggtcctgggtccgtcagccaccgggtcgcggtctggagtggatcggctacatcagctacagcggcatcaccacttacaacccgtccctgaaaagccgtgtcaccatgctgcgtgacacctccaaaaatcaattctccctgcgcctgagctctgtgacggcggccgacactgcggtgtactactgcgctcgcagcctggcgcgtaccactgctatggattactggggtcagggcagcctggtaaccgtcagcagctaa

SEQ ID NO: 703 - DNA, 3387 bp, Artificial Sequence
  Description of Artificial Sequence: Synthetic polynucleotide
atggctgatattcaaatgactcaatctccttcttctctgtccgcatctgtaggcgaccgtgtaaccatcacttgccgtgcctcccaggacatctccagctacctgaactggtaccagcagaagccgggcaaggctccgaaactgctgatttattacactagccgtctgcattctggtgttccgagccgcttctccggttctggcagcggtaccgatttcacttttactatctccagcctgcaaccggaggacatcgcgacgtactattgccagcaaggtaataccctgccgtacaccttcggccaaggcacgaaagttgaaatcaaaaccggttctggcgaaggctctgaaggtgaaggtggtggtgaaggctctgaaggtgaaggatctggtgaaggtggcgaaggtgagggttctggatcccaagttcagctgcaggaatctggtccgggtctggttcgtccgtctcagaccctgtccctgacctgcacggtgtccggctactctattacctctgaccatgcgtggtcctgggtccgtcagccaccgggtcgcggtctggagtggatcggctacatcagctacagcggcatcaccacttacaacccgtccctgaaaagccgtgtcaccatgctgcgtgacacctccaaaaatcaattctccctgcgcctgagctctgtgacggcggccgacactgcggtgtactactgcgctcgcagcctggcgcgtaccactgctatggattactggggtcagggcagcctggtaaccgtcagcagcgggtctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggttaa

SEQ ID NO: 704 - DNA, 3960 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtgctgatattcaaatgactcaatctccttcttctctgtccgcatctgtaggcgaccgtgtaaccatcacttgccgtgcctcccaggacatctccagctacctgaactggtaccagcagaagccgggcaaggctccgaaactgctgatttattacactagccgtctgcattctggtgttccgagccgcttctccggttctggcagcggtaccgatttcacttttactatctccagcctgcaaccggaggacatcgcgacgtactattgccagcaaggtaataccctgccgtacaccttcggccaaggcacgaaagttgaaatcaaaaccggttctggcgaaggctctgaaggtgaaggtggtggtgaaggctctgaaggtgaaggatctggtgaaggtggcgaaggtgagggttctggatcccaagttcagctgcaggaatctggtccgggtctggttcgtccgtctcagaccctgtccctgacctgcacggtgtccggctactctattacctctgaccatgcgtggtcctgggtccgtcagccaccgggtcgcggtctggagtggatcggctacatcagctacagcggcatcaccacttacaacccgtccctgaaaagccgtgtcaccatgctgcgtgacacctccaaaaatcaattctccctgcgcctgagctctgtgacggcggccgacactgcggtgtactactgcgctcgcagcctggcgcgtaccactgctatggattactggggtcagggcagcctggtaaccgtcagcagcggaggtacttctgaaagcgctactccggagtccggtccaggtacctctaccgaaccgtccgaaggcagcgctccaggtacttctactgaaccttctgagggtagcgctccaggtacttctgaaagcgctactccggagtccggtccaggtacctctaccgaaccgtccgaaggcagcgctccaggtacttctactgaaccttctgagggtagcgctccaggtacctctgaaagcgctactccggagtctggcccaggtacctctactgaaccgtctgagggtagcgctccaggtacttctactgaaccgtccgaaggtagcgcaccaggtacttctaccgaaccgtccgagggtagcgcaccaggtagcccagcaggttctcctacctccaccgaggaaggtacttctaccgaaccgtccgagggtagcgcaccaggttaa

SEQ ID NO: 705 - DNA, 3534 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccagggtctccaggtgatattcaaatgactcaatctccttcttctctgtccgcatctgtaggcgaccgtgtaaccatcacttgccgtgcctcccaggacatctccagctacctgaactggtaccagcagaagccgggcaaggctccgaaactgctgatttattacactagccgtctgcattctggtgttccgagccgcttctccggttctggcagcggtaccgatttcacttttactatctccagcctgcaaccggaggacatcgcgacgtactattgccagcaaggtaataccctgccgtacaccttcggccaaggcacgaaagttgaaatcaaaaccggttctggcgaaggctctgaaggtgaaggtggtggtgaaggctctgaaggtgaaggatctggtgaaggtggcgaaggtgagggttctggatcccaagttcagctgcaggaatctggtccgggtctggttcgtccgtctcagaccctgtccctgacctgcacggtgtccggctactctattacctctgaccatgcgtggtcctgggtccgtcagccaccgggtcgcggtctggagtggatcggctacatcagctacagcggcatcaccacttacaacccgtccctgaaaagccgtgtcaccatgctgcgtgacacctccaaaaatcaattctccctgcgcctgagctctgtgacggcggccgacactgcggtgtactactgcgctcgcagcctggcgcgtaccactgctatggattactggggtcagggcagcctggtaaccgtcagcagcggaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggttaa

SEQ ID NO: 706 - DNA, 3384 bp, Artificial Sequence
  Description of Artificial Sequence: Synthetic polynucleotide
atggctgaaattgttctgacccaatctcctgcaactctgtctctgtctccaggtgaacgcgccaccctgtcttgtcgtgcgtcccagtctatctctgattatctgcattggtatcagcagaaacctggccaggctccgcgcctgctgatctattacgccagccacagcatctctggtatcccggctcgcttctccggctccggcagcggcaccgacttcactctgactattagctccctggaaccggaggatttcgcagtttattactgtcagcacggtcactcctacccgtggacctttggtggcggcaccaaagttgaaatcaaaaccggttctggcgaaggctctgaaggtgaaggtggtggtgaaggctctgaaggtgaaggatctggtgaaggtggcgaaggtgagggatctggtacccaagtccagctggttcagtccggctctgaactgaagaaaccgggcgcttctgttaaagttagctgcaaagcaagcggttatgcctttactactactggtatgcagtgggtccgccaggcaccgggtcagggcctggagtggatgggctggatcaacacccactctggtgtccctaaatacgttgaagatttcaaaggccgtttcgtgttctccctggacacttccgtcagcaccgcgtatctgcagatcagcagcctgaaagctgaggacaccgcggtttattactgcgcgcgtagcggcaatggtaactacgacctggcttatttcaaatactggggtcagggcactctggttactgtgtctagcggaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 707 - DNA, 3384 bp, Artificial Sequence
  Description of Artificial Sequence: Synthetic polynucleotide
atggctgaaattgttctgactcaatctccagcaactctgtctctgtctccaggtgaacgtgcaaccctgtcttgccgtgcgtcccagtccatctccgattatctgcattggtatcagcagaaaccgggtcaggcgcctcgtctgctgatctattatgcgtctcactccatttccggtatcccggcacgtttctctggcagcggcagcggcaccgatttcaccctgacgatctcttctctggaaccggaagatttcgcagtctattattgtcagcatggtcacagctacccgtggaccttcggcggtggcacgaaagttgaaatcaagaccggttctggcgaaggctctgaaggtgaaggtggtggtgaaggctctgaaggtgaaggatctggtgaaggtggcgaaggtgagggatctggtacccaggtccagctggttcaaagcggctctgaactgaaaaagccgggtgcctctgtcaaagtgtcttgcaaggcaagcggctacgcgtttacgaccaccggcatgcagtgggtccgtcaggccccgggccagggtctggaatggatgggctggatcaacacccattctggcgtaccgaaatacgttgaagatttcaaaggccgtttcgtgttctccctggatacgtccgtttccaccgcctacctgcagatctcttccctgaaagcagaagatactgcggtgtactattgcgcacgtagcggcaacggcaactacgacctggcctacttcaaatactggggtcagggtactctggtgaccgtatcctctggaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 708 - DNA, 3525 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtgaaattgttctgacccaatctcctgcaactctgtctctgtctccaggtgaacgcgccaccctgtcttgtcgtgcgtcccagtctatctctgattatctgcattggtatcagcagaaacctggccaggctccgcgcctgctgatctattacgccagccacagcatctctggtatcccggctcgcttctccggctccggcagcggcaccgacttcactctgactattagctccctggaaccggaggatttcgcagtttattactgtcagcacggtcactcctacccgtggacctttggtggcggcaccaaagttgaaatcaaaaccggttctggcgaaggctctgaaggtgaaggtggtggtgaaggctctgaaggtgaaggatctggtgaaggtggcgaaggtgagggatctggtacccaagtccagctggttcagtccggctctgaactgaagaaaccgggcgcttctgttaaagttagctgcaaagcaagcggttatgcctttactactactggtatgcagtgggtccgccaggcaccgggtcagggcctggagtggatgggctggatcaacacccactctggtgtccctaaatacgttgaagatttcaaaggccgtttcgtgttctccctggacacttccgtcagcaccgcgtatctgcagatcagcagcctgaaagctgaggacaccgcggtttattactgcgcgcgtagcggcaatggtaactacgacctggcttatttcaaatactggggtcagggcactctggttactgtgtctagc

SEQ ID NO: 709 - DNA, 3525 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggtgaaattgttctgactcaatctccagcaactctgtctctgtctccaggtgaacgtgcaaccctgtcttgccgtgcgtcccagtccatctccgattatctgcattggtatcagcagaaaccgggtcaggcgcctcgtctgctgatctattatgcgtctcactccatttccggtatcccggcacgtttctctggcagcggcagcggcaccgatttcaccctgacgatctcttctctggaaccggaagatttcgcagtctattattgtcagcatggtcacagctacccgtggaccttcggcggtggcacgaaagttgaaatcaagaccggttctggcgaaggctctgaaggtgaaggtggtggtgaaggctctgaaggtgaaggatctggtgaaggtggcgaaggtgagggatctggtacccaggtccagctggttcaaagcggctctgaactgaaaaagccgggtgcctctgtcaaagtgtcttgcaaggcaagcggctacgcgtttacgaccaccggcatgcagtgggtccgtcaggccccgggccagggtctggaatggatgggctggatcaacacccattctggcgtaccgaaatacgttgaagatttcaaaggccgtttcgtgttctccctggatacgtccgtttccaccgcctacctgcagatctcttccctgaaagcagaagatactgcggtgtactattgcgcacgtagcggcaacggcaactacgacctggcctacttcaaatactggggtcagggtactctggtgaccgtatcctct

SEQ ID NO: 710 - DNA, 3381 bp, Artificial Sequence
  Description of Artificial Sequence: Synthetic polynucleotide
atggaagacattcagatgacccagagcccgtcctccctgagcgcttctgttggcgaccgcgtgaccatcacctgccgtgcttcccaggatgttaacaccgctgtagcttggtatcaacagaaaccgggcaaagcaccgaaactgctgatctactctgcttcctttctgtatagcggtgttccgtctcgtttcagcggctctcgtagcggtacggattttactctgacgatcagctctctgcagccggaggacttcgctacctactactgccagcagcactacaccaccccgcctacctttggtcagggcaccaaagtggaaatcaagaccggttctggcgaaggctctgaaggtgaaggtggtggtgaaggctctgaaggtgaaggatctggtgaaggtggcgaaggtgagggatctggtaccgaggtccagctggttgagtctggcggcggtctggtccaacctggtggctccctgcgcctgtcttgcgcagcgtccggctttaatatcaaagatacgtacattcactgggtccgccaggcaccgggcaaaggcctggaatgggttgctcgtatctacccgactaacggttatacccgttatgcagacagcgtaaagggtcgcttcacgatctccgcggatacctccaaaaacaccgcatacctgcaaatgaactctctgcgtgcggaagatactgccgtgtactactgctctcgctggggcggtgacggtttctatgcaatggactactggggtcaaggtactctggtaactgtttccgggtctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 711 - DNA, 2517 bp, Artificial Sequence
  Description of Artificial Sequence: Synthetic polynucleotide
atggaagacattcagatgacccagagcccgtcctccctgagcgcttctgttggcgaccgcgtgaccatcacctgccgtgcttcccaggatgttaacaccgctgtagcttggtatcaacagaaaccgggcaaagcaccgaaactgctgatctactctgcttcctttctgtatagcggtgttccgtctcgtttcagcggctctcgtagcggtacggattttactctgacgatcagctctctgcagccggaggacttcgctacctactactgccagcagcactacaccaccccgcctacctttggtcagggcaccaaagtggaaatcaagaccggttctggcgaaggctctgaaggtgaaggtggtggtgaaggctctgaaggtgaaggatctggtgaaggtggcgaaggtgagggatctggtaccgaggtccagctggttgagtctggcggcggtctggtccaacctggtggctccctgcgcctgtcttgcgcagcgtccggctttaatatcaaagatacgtacattcactgggtccgccaggcaccgggcaaaggcctggaatgggttgctcgtatctacccgactaacggttatacccgttatgcagacagcgtaaagggtcgcttcacgatctccgcggatacctccaaaaacaccgcatacctgcaaatgaactctctgcgtgcggaagatactgccgtgtactactgctctcgctggggcggtgacggtttctatgcaatggactactggggtcaaggtactctggtaactgtttccgggtctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcacca

SEQ ID NO: 712 - DNA, 1653 bp, Artificial Sequence
  Description of Artificial Sequence: Synthetic polynucleotide
atggaagacattcagatgacccagagcccgtcctccctgagcgcttctgttggcgaccgcgtgaccatcacctgccgtgcttcccaggatgttaacaccgctgtagcttggtatcaacagaaaccgggcaaagcaccgaaactgctgatctactctgcttcctttctgtatagcggtgttccgtctcgtttcagcggctctcgtagcggtacggattttactctgacgatcagctctctgcagccggaggacttcgctacctactactgccagcagcactacaccaccccgcctacctttggtcagggcaccaaagtggaaatcaagaccggttctggcgaaggctctgaaggtgaaggtggtggtgaaggctctgaaggtgaaggatctggtgaaggtggcgaaggtgagggatctggtaccgaggtccagctggttgagtctggcggcggtctggtccaacctggtggctccctgcgcctgtcttgcgcagcgtccggctttaatatcaaagatacgtacattcactgggtccgccaggcaccgggcaaaggcctggaatgggttgctcgtatctacccgactaacggttatacccgttatgcagacagcgtaaagggtcgcttcacgatctccgcggatacctccaaaaacaccgcatacctgcaaatgaactctctgcgtgcggaagatactgccgtgtactactgctctcgctggggcggtgacggtttctatgcaatggactactggggtcaaggtactctggtaactgtttccgggtctccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcacca

SEQ ID NO: 713 - DNA, 3528 bp, Artificial Sequence
  Description of Artificial Sequence: Synthetic polynucleotide
atggctgaacctgctggctctccaacctccactgaggaaggtaccccgggtagcggtactgcttcttcctctccaggtagctctaccccttctggtgcaaccggctctccaggtgcttctccgggcaccagctctaccggttctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggttcgtcttcactcgacattcagatgacccagagcccgtcctccctgagcgcttctgttggcgaccgcgtgaccatcacctgccgtgcttcccaggatgttaacaccgctgtagcttggtatcaacagaaaccgggcaaagcaccgaaactgctgatctactctgcttcctttctgtatagcggtgttccgtctcgtttcagcggctctcgtagcggtacggattttactctgacgatcagctctctgcagccggaggacttcgctacctactactgccagcagcactacaccaccccgcctacctttggtcagggcaccaaagtggaaatcaagaccggttctggcgaaggctctgaaggtgaaggtggtggtgaaggctctgaaggtgaaggatctggtgaaggtggcgaaggtgagggatctggtaccgaggtccagctggttgagtctggcggcggtctggtccaacctggtggctccctgcgcctgtcttgcgcagcgtccggctttaatatcaaagatacgtacattcactgggtccgccaggcaccgggcaaaggcctggaatgggttgctcgtatctacccgactaacggttatacccgttatgcagacagcgtaaagggtcgcttcacgatctccgcggatacctccaaaaacaccgcatacctgcaaatgaactctctgcgtgcggaagatactgccgtgtactactgctctcgctggggcggtgacggtttctatgcaatggactactggggtcaaggtactctggtaactgtttcc

SEQ ID NO: 714 - DNA, 2565 bp, Artificial Sequence
  Description of Artificial Sequence: Synthetic polynucleotide
atggaggatattctgctgacgcaaagccctgttattctgtctgttagcccgggtgagcgcgttagcttcagctgccgtgcatctcagagcattggcacgaacattcattggtatcaacaacgtaccaacggtagcccgcgtctgctgattaaatacgcatccgaatctatctctggtatcccgtctcgcttcagcggttctggtagcggcaccgactttaccctgagcattaactctgtagaaagcgaagatattgcggattactactgccagcagaacaacaactggccgactacttttggtgcaggtactaaactggaactgaaaaccggttctggcgaaggctctgaaggtgaaggtggtggtgaaggctctgaaggtgaaggatctggtgaaggtggcgaaggtgagggatctggtacccaagtgcagctgaaacagagcggtccgggtctggtgcaaccatcccagtctctgtctattacctgtaccgttagcggtttctccctgaccaactacggtgttcactgggttcgccagtccccaggcaaaggcctggaatggctgggcgttatttggtccggcggcaatacggattataacaccccgttcacctctcgtctgtctatcaacaaagataattctaaaagccaggtattcttcaagatgaactctctgcagagcaatgacaccgccatctactattgcgctcgtgccctgacttactacgattacgagttcgcatattggggccagggcactctggtgaccgtttccggaggtgagggttctggcgaaggttccgaaggtgagggctccgaaggatctggcgaaggtgagggttccgaaggttctggcgaaggtgaaggcggttctgagggatccgaaggtgaaggctccgaaggatctggcgaaggtgaaggtggtgaaggttctggcgaaggtgagggatctggcgaaggctctgaaggtgaaggtggtggtgaaggctctgaaggtgaaggatctggtgaaggtggcgaaggtgagggatctgaaggcggctccgaaggtgaaggcggatctgaaggcggcgaaggtgaaggttccgaaggttctggtgaaggtgaaggatctgaaggtggctccgaaggtgaaggatctgaaggcggttccgaaggtgagggctctgaaggttctggcgaaggtgaaggctctgaaggatctggtgaaggtgaaggttccgaaggttctggtgaaggtgaaggttccgaaggttctggcgaaggtgaaggttctgaaggtggctctgaaggtgaaggcggctctgaaggatccgaaggtgaaggttctggtgaaggctctgaaggtgaaggcggctctgagggttccgaaggtgaaggcggaggcgaaggttctgaaggtgagggatctggtgaaggttctgaaggtgaaggcggttctgaaggttccgaaggtgaaggtggctctgagggatccgaaggtgaaggtggcgaaggatctggtgaaggtgaaggttctgaaggttctggcgaaggtgagggttctggcgaaggttccgaaggtgagggctccgaaggatctggcgaaggtgagggttccgaaggttctggcgaaggtgaaggcggttctgagggatccgaaggtgagggttctggcgaaggttccgaaggtgagggctccgaaggatctggcgaaggtgagggttccgaaggttctggcgaaggtgaaggcggttctgagggatccgaaggtgaaggcggttctgaaggttccgaaggtgaaggtggctctgagggatccgaaggtgaaggtggcgaaggatctggtgaaggtgaaggttctgaaggttctggcgaaggtgagggttctggcgaaggttccgaaggtgagggctccgaaggatctggcgaaggtgagggttccgaaggttctggcgaaggtgaaggcggttctgagggatccgaaggtgaaggctccgaaggatctggcgaaggtgaaggtggtgaaggttctggcgaaggtgagggatctggcgaaggctctgaaggtgaaggtggtggtgaaggctctgaaggtgaaggttccgaaggttctggtgaaggtgaaggttccgaaggttctggcgaaggtgaaggttctgaaggtggctctgaaggtgaaggcggctctgaaggatccgaaggtgaaggatctgaaggtggctccgaaggtgaaggatctgaaggcggttccgaaggtgagggctctgaaggttctggcgaaggtgaaggctctgaaggatctggtgaaggtgaaggatctggcgaaggctccgaaggtgaaggcggttctgaaggtggcgaaggtgaaggatctgaaggtggttccgaaggtgagggatctgaaggtggctctgaaggtgaaggtggcgaaggttctggcgaaggtgaaggtggaggcgaaggttctgaaggtgaaggttccgaaggttctggtgaaggtgagggatctggcgaaggttctgaaggtgattataaagacgatgacgataaaggtggttctcatcaccatcaccatcactaa

SEQ ID NO: 715 - DNA, 2379 bp, Artificial Sequence
  Description of Artificial Sequence: Synthetic polynucleotide
atgaaagacatccagatgacccagtctccttcctctctgtccgcgtccgtgggcgaccgtgttactatcacctgctccgcctcctcttctgtcagctacatgaactggtatcagcagactcctggcaaagctccaaaacgttggatttacgatacgtccaagctggcctccggcgtaccaagccgtttctctggctctggcagcggcacggattacaccttcactatttctagcctgcagcctgaagatattgccacctattactgccaacaatggtcctccaatccttttacctttggtcagggcactaagctgcagattactcgcaccggttctggcgaaggctctgaaggtgaaggtggtggtgaaggctctgaaggtgaaggatctggtgaaggtggcgaaggtgagggatctggtacccaggtccaactggttcaatccggcggcggtgtagttcaaccgggtcgctctctgcgtctttcctgcaaggcgtccggttacactttcacgcgttacaccatgcactgggtccgtcaggctcctggtaaaggtctggaatggattggctatatcaacccgtctcgcggctataccaactataaccagaaattcaaagatcgttttacgatttccactgataaatccaaaagcaccgcattcctccaaatggacagcctgcgtccggaagacacggcggtttattattccgcccgttactacgatgaccactactgcctggattattggggccaaggcactccagtaaccgtgagcagcggaggtgagggttctggcgaaggttccgaaggtgagggctccgaaggatctggcgaaggtgagggttccgaaggttctggcgaaggtgaaggcggttctgagggatccgaaggtgaaggcggttctgagggatctgaaggtgaaggtggctctgaaggatctgaaggtgagggatctggtgaaggttctgaaggtgaaggcggctctgagggttctgaaggtgaaggatctggtgaaggttccgaaggtgagggttctgaaggtggttctgaaggtgaaggcggttctgagggttctgaaggtgagggttctggcgaaggttccgaaggtgaaggcggcgaaggtggatctgaaggtgagggctccgaaggatctggcgaaggtgaaggttctggcgaaggttccgaaggtgaaggttctgaaggatctggcgaaggtgagggttctggcgaaggttccgaaggtgagggctccgaaggatctggcgaaggtgagggttccgaaggttctggcgaaggtgaaggcggttctgagggatccgaaggtgaaggctccgaaggatctggcgaaggtgaaggtggtgaaggttctggcgaaggtgagggatctggcgaaggctctgaaggtgaaggtggtggtgaaggctctgaaggtgaaggatctggtgaaggtggcgaaggtgagggatctgaaggcggctccgaaggtgaaggcggatctgaaggcggcgaaggtgaaggttccgaaggttctggtgaaggtgaaggatctgaaggtggctccgaaggtgaaggatctgaaggcggttccgaaggtgagggctctgaaggttctggcgaaggtgaaggctctgaaggatctggtgaaggttcgtcttcactcgagggtaccgaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttctcttatggtgttcaatgcttttcccgttatccggatcacatgaaacggcatgactttttcaagagtgccatgcccgaaggttatgtacaggaacgcactatatctttcaaagatgacgggaactacaagacgcgtgctgaagtcaagtttgaaggtgatacccttgttaatcgtatcgagttaaaaggtattgattttaaagaagatggaaacattctcggacacaaactcgagtacaactataactcacacaatgtatacatcacggcagacaaacaaaagaatggaatcaaagctaacttcaaaattcgccacaacattgaagatggatccgttcaactagcagaccattatcaacaaaatactccaattggcgatggccctgtccttttaccagacaaccattacctgtcgacacaatctgccctttcgaaagatcccaacgaaaagcgtgaccacatggtccttcttgagtttgtaactgctgctgggattggtggctctcatcaccatcaccatcaccatcactaa

SEQ ID NO: 716 - DNA, 2487 bp, Artificial Sequence
  Description of Artificial Sequence: Synthetic polynucleotide
atggaggacattcagatgacccagagcccgtcctccctgagcgcttctgttggcgaccgcgtgaccatcacctgccgtgcttcccaggatgttaacaccgctgtagcttggtatcaacagaaaccgggcaaagcaccgaaactgctgatctactctgcttcctttctgtatagcggtgttccgtctcgtttcagcggctctcgtagcggtacggattttactctgacgatcagctctctgcagccggaggacttcgctacctactactgccagcagcactacaccaccccgcctacctttggtcagggcaccaaagtggaaatcaagaccggttctggcgaaggctctgaaggtgaaggtggtggtgaaggctctgaaggtgaaggatctggtgaaggtggcgaaggtgagggatctggtaccgaggtccagctggttgagtctggcggcggtctggtccaacctggtggctccctgcgcctgtcttgcgcagcgtccggctttaatatcaaagatacgtacattcactgggtccgccaggcaccgggcaaaggcctggaatgggttgctcgtatctacccgactaacggttatacccgttatgcagacagcgtaaagggtcgcttcacgatctccgcggatacctccaaaaacaccgcatacctgcaaatgaactctctgcgtgcggaagatactgccgtgtactactgctctcgctggggcggtgacggtttctatgcaatggactactggggtcaaggtactctggtaactgtttccggaggtgagggttctggcgaaggttccgaaggtgagggctccgaaggatctggcgaaggtgagggttccgaaggttctggcgaaggtgaaggcggttctgagggatccgaaggtgaaggcggttctgagggatctgaaggtgaaggtggctctgaaggatctgaaggtgagggatctggtgaaggttctgaaggtgaaggcggctctgagggttctgaaggtgaaggatctggtgaaggttccgaaggtgagggttctgaaggtggttctgaaggtgaaggcggttctgagggttctgaaggtgagggttctggcgaaggttccgaaggtgaaggcggcgaaggtggatctgaaggtgagggctccgaaggatctggcgaaggtgaaggttctggcgaaggttccgaaggtgaaggttctgaaggatctggcgaaggtgagggttctggcgaaggttccgaaggtgagggctccgaaggatctggcgaaggtgagggttccgaaggttctggcgaaggtgaaggcggttctgagggatccgaaggtgaaggctccgaaggatctggcgaaggtgaaggtggtgaaggttctggcgaaggtgagggatctggcgaaggctctgaaggtgaaggtggtggtgaaggctctgaaggtgaaggatctggtgaaggtggcgaaggtgagggatctgaaggcggctccgaaggtgaaggcggatctgaaggcggcgaaggtgaaggttccgaaggttctggtgaaggtgaaggatctgaaggtggctccgaaggtgaaggatctgaaggcggttccgaaggtgagggctctgaaggttctggcgaaggtgaaggctctgaaggatctggtgaaggtgacatccagatgacccagtctccttcctctctgtccgcgtccgtgggcgaccgtgttactatcacctgctccgcctcctcttctgtcagctacatgaactggtatcagcagactcctggcaaagctccaaaacgttggatttacgatacgtccaagctggcctccggcgtaccaagccgtttctctggctctggcagcggcacggattacaccttcactatttctagcctgcagcctgaagatattgccacctattactgccaacaatggtcctccaatccttttacctttggtcagggcactaagctgcagattactcgcaccggttctggcgaaggctctgaaggtgaaggtggtggtgaaggctctgaaggtgaaggatctggtgaaggtggcgaaggtgagggatctggtacccaggtccaactggttcaatccggcggcggtgtagttcaaccgggtcgctctctgcgtctttcctgcaaggcgtccggttacactttcacgcgttacaccatgcactgggtccgtcaggctcctggtaaaggtctggaatggattggctatatcaacccgtctcgcggctataccaactataaccagaaattcaaagatcgttttacgatttccactgataaatccaaaagcaccgcattcctccaaatggacagcctgcgtccggaagacacggcggtttattattccgcccgttactacgatgaccactactgcctggattattggggccaaggcactccagtaaccgtgagcagcggcggttatccttatgatgttccagactatgcaggtggctctcatcaccatcaccatcactga

SEQ ID NO: 717 - DNA, 2487 bp, Artificial Sequence
  Description of Artificial Sequence: Synthetic polynucleotide
atggaggacattcagatgacccagagcccgtcctccctgagcgcttctgttggcgaccgcgtgaccatcacctgccgtgcttcccaggatgttaacaccgctgtagcttggtatcaacagaaaccgggcaaagcaccgaaactgctgatctactctgcttcctttctgtatagcggtgttccgtctcgtttcagcggctctcgtagcggtacggattttactctgacgatcagctctctgcagccggaggacttcgctacctactactgccagcagcactacaccaccccgcctacctttggtcagggcaccaaagtggaaatcaagaccggttctggcgaaggctctgaaggtgaaggtggtggtgaaggctctgaaggtgaaggatctggtgaaggtggcgaaggtgagggatctggtaccgaggtccagctggttgagtctggcggcggtctggtccaacctggtggctccctgcgcctgtcttgcgcagcgtccggctttaatatcaaagatacgtacattcactgggtccgccaggcaccgggcaaaggcctggaatgggttgctcgtatctacccgactaacggttatacccgttatgcagacagcgtaaagggtcgcttcacgatctccgcggatacctccaaaaacaccgcatacctgcaaatgaactctctgcgtgcggaagatactgccgtgtactactgctctcgctggggcggtgacggtttctatgcaatggactactggggtcaaggtactctggtaactgtttccggaggtgagggttctggcgaaggttccgaaggtgagggctccgaaggatctggcgaaggtgagggttccgaaggttctggcgaaggtgaaggcggttctgagggatccgaaggtgaaggcggttctgagggatctgaaggtgaaggtggctctgaaggatctgaaggtgagggatctggtgaaggttctgaaggtgaaggcggctctgagggttctgaaggtgaaggatctggtgaaggttccgaaggtgagggttctgaaggtggttctgaaggtgaaggcggttctgagggttctgaaggtgagggttctggcgaaggttccgaaggtgaaggcggcgaaggtggatctgaaggtgagggctccgaaggatctggcgaaggtgaaggttctggcgaaggttccgaaggtgaaggttctgaaggatctggcgaaggtgagggttctggcgaaggttccgaaggtgagggctccgaaggatctggcgaaggtgagggttccgaaggttctggcgaaggtgaaggcggttctgagggatccgaaggtgaaggctccgaaggatctggcgaaggtgaaggtggtgaaggttctggcgaaggtgagggatctggcgaaggctctgaaggtgaaggtggtggtgaaggctctgaaggtgaaggatctggtgaaggtggcgaaggtgagggatctgaaggcggctccgaaggtgaaggcggatctgaaggcggcgaaggtgaaggttccgaaggttctggtgaaggtgaaggatctgaaggtggctccgaaggtgaaggatctgaaggcggttccgaaggtgagggctctgaaggttctggcgaaggtgaaggctctgaaggatctggtgaaggtgaggatattctgctgacgcaaagccctgttattctgtctgttagcccgggtgagcgcgttagcttcagctgccgtgcatctcagagcattggcacgaacattcattggtatcaacaacgtaccaacggtagcccgcgtctgctgattaaatacgcatccgaatctatctctggtatcccgtctcgcttcagcggttctggtagcggcaccgactttaccctgagcattaactctgtagaaagcgaagatattgcggattactactgccagcagaacaacaactggccgactacttttggtgcaggtactaaactggaactgaaaaccggttctggcgaaggctctgaaggtgaaggtggtggtgaaggctctgaaggtgaaggatctggtgaaggtggcgaaggtgagggatctggtacccaagtgcagctgaaacagagcggtccgggtctggtgcaaccatcccagtctctgtctattacctgtaccgttagcggtttctccctgaccaactacggtgttcactgggttcgccagtccccaggcaaaggcctggaatggctgggcgttatttggtccggcggcaatacggattataacaccccgttcacctctcgtctgtctatcaacaaagataattctaaaagccaggtattcttcaagatgaactctctgcagagcaatgacaccgccatctactattgcgctcgtgccctgacttactacgattacgagttcgcatattggggccagggcactctggtgaccgtttccggcggttatccttatgatgttccagactatgcaggtggctctcatcaccatcaccatcactga

SEQ ID NO: 718 - DNA, 2529 bp, Artificial Sequence
  Description of Artificial Sequence: Synthetic polynucleotide
atggaggacattcagatgacccagagcccgtcctccctgagcgcttctgttggcgaccgcgtgaccatcacctgccgtgcttcccaggatgttaacaccgctgtagcttggtatcaacagaaaccgggcaaagcaccgaaactgctgatctactctgcttcctttctgtatagcggtgttccgtctcgtttcagcggctctcgtagcggtacggattttactctgacgatcagctctctgcagccggaggacttcgctacctactactgccagcagcactacaccaccccgcctacctttggtcagggcaccaaagtggaaatcaagaccggttctggcgaaggctctgaaggtgaaggtggtggtgaaggctctgaaggtgaaggatctggtgaaggtggcgaaggtgagggatctggtaccgaggtccagctggttgagtctggcggcggtctggtccaacctggtggctccctgcgcctgtcttgcgcagcgtccggctttaatatcaaagatacgtacattcactgggtccgccaggcaccgggcaaaggcctggaatgggttgctcgtatctacccgactaacggttatacccgttatgcagacagcgtaaagggtcgcttcacgatctccgcggatacctccaaaaacaccgcatacctgcaaatgaactctctgcgtgcggaagatactgccgtgtactactgctctcgctggggcggtgacggtttctatgcaatggactactggggtcaaggtactctggtaactgtttccgggtctccaggtgagggttctggcgaaggttccgaaggtgagggctccgaaggatctggcgaaggtgagggttccgaaggttctggcgaaggtgaaggcggttctgagggatccgaaggtgaaggcggttctgagggatctgaaggtgaaggtggctctgaaggatctgaaggtgagggatctggtgaaggttctgaaggtgaaggcggctctgagggttctgaaggtgaaggatctggtgaaggttccgaaggtgagggttctgaaggtggttctgaaggtgaaggcggttctgagggttctgaaggtgagggttctggcgaaggttccgaaggtgaaggcggcgaaggtggatctgaaggtgagggctccgaaggatctggcgaaggtgaaggttctggcgaaggttccgaaggtgaaggttctgaaggatctggcgaaggtgagggttctggcgaaggttccgaaggtgagggctccgaaggatctggcgaaggtgagggttccgaaggttctggcgaaggtgaaggcggttctgagggatccgaaggtgaaggctccgaaggatctggcgaaggtgaaggtggtgaaggttctggcgaaggtgagggatctggcgaaggctctgaaggtgaaggtggtggtgaaggctctgaaggtgaaggatctggtgaaggtggcgaaggtgagggatctgaaggcggctccgaaggtgaaggcggatctgaaggcggcgaaggtgaaggttccgaaggttctggtgaaggtgaaggatctgaaggtggctccgaaggtgaaggatctgaaggcggttccgaaggtgagggctctgaaggttctggcgaaggtgaaggctctgaaggatctggtgaaggttcgtcttcactcgagggtaccaaagacatccagatgacccagtctccttcctctctgtccgcgtccgtgggcgaccgtgttactatcacctgctccgcctcctcttctgtcagctacatgaactggtatcagcagactcctggcaaagctccaaaacgttggatttacgatacgtccaagctggcctccggcgtaccaagccgtttctctggctctggcagcggcacggattacaccttcactatttctagcctgcagcctgaagatattgccacctattactgccaacaatggtcctccaatccttttacctttggtcagggcactaagctgcagattactcgcaccggttctggcgaaggctctgaaggtgaaggtggtggtgaaggctctgaaggtgaaggatctggtgaaggtggcgaaggtgagggatctggtacccaggtccaactggttcaatccggcggcggtgtagttcaaccgggtcgctctctgcgtctttcctgcaaggcgtccggttacactttcacgcgttacaccatgcactgggtccgtcaggctcctggtaaaggtctggaatggattggctatatcaacccgtctcgcggctataccaactataaccagaaattcaaagatcgttttacgatttccactgataaatccaaaagcaccgcattcctccaaatggacagcctgcgtccggaagacacggcggtttattattccgcccgttactacgatgaccactactgcctggattattggggccaaggcactccagtaaccgtgagcagcactagtggcggttatccttatgatgttccagactatgcaggtggctctcatcaccatcaccatcaccaccattga

SEQ ID NO: 719 - DNA, 1566 bp, Artificial Sequence
  Description of Artificial Sequence: Synthetic polynucleotide
atgaaagggtctccaggtgaagtacagcttcaagaatctggtggtggtcttgtccaggcgggcgattccctgcgcctgtcttgtctggtctctggtcgttcatttaacagctataccatgggctggttccgccaagcaccgggcaaggaacgtgaattcgtagcagctattctctggtccggtcctacgacctactatgctgactctgtaaaaggtcgcttcaccatctcccgtgataacgccaaaaacaccgtatatcttcagatgaactctctgaaaccggaggacacggccgtgtactattgtgccgctgcgctgggtgtactggtgctagcgcctggtaatgtctacagctattggggtcaaggtacccaggtcacggtaagctccgcgcatcatggaggtaccccgggcagcggtaccgcatcttcctctccaggtagctctaccccgtctggtgctaccggttccccaggtagctctaccccgtctggtgcaaccggctccccaggtagcccggctggctctcctacctctactgaggaaggtacttctgaaagcgctactcctgagtctggtccaggtacctctactgaaccgtccgaaggtagcgctccaggttctagcccttctgcatccaccggtaccggcccaggttctagcccgtctgcttctaccggtactggtccaggtgcttctccgggtactagctctactggttctccaggtacctctaccgaaccgtccgagggtagcgcaccaggtacctctactgaaccgtctgagggtagcgctccaggtagcgaaccggcaacctccggttctgaaactccaggttcgtcttcactcgagggtaccgaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttctcttatggtgttcaatgcttttcccgttatccggatcacatgaaacggcatgactttttcaagagtgccatgcccgaaggttatgtacaggaacgcactatatctttcaaagatgacgggaactacaagacgcgtgctgaagtcaagtttgaaggtgatacccttgttaatcgtatcgagttaaaaggtattgattttaaagaagatggaaacattctcggacacaaactcgagtacaactataactcacacaatgtatacatcacggcagacaaacaaaagaatggaatcaaagctaacttcaaaattcgccacaacattgaagatggatccgttcaactagcagaccattatcaacaaaatactccaattggcgatggccctgtccttttaccagacaaccattacctgtcgacacaatctgccctttcgaaagatcccaacgaaaagcgtgaccacatggtccttcttgagtttgtaactgctgctgggattggtggctctcatcaccatcaccatcaccatcactaa

SEQ ID NO: 720 - DNA, 1566 bp, Artificial Sequence
  Description of Artificial Sequence: Synthetic polynucleotide
atgaaagggtctccaggtgaagtgcagcttcaagaatctggtggtggtctggtacaagccggtgattctctgcgcctgtcttgtctggtctccggtcgctcttttaacagctataccatgggctggttccgccaggcaccaggcaaagagcgtgaattcgtagcagctatcctgtggtctggtccgactacctactatgctgactctgtaaagggtcgcttcacgatttcccgtgataacgccaaaaacacggtgtatctacaaatgaattctctgaaaccggaggacactgccgtttactattgtgccgctgcgctgggtgtactggtgcttgcccctggtaatgtatacagctattggggtcaaggtacgcaagttaccgtgagctctgcgcatcatggaggtacttctaccgaaccgtccgagggcagcgctccaggtacttctactgaaccttctgaaggcagcgctccaggtacttctactgaaccttccgaaggtagcgcaccaggttctaccagcgaatccccttctggtactgctccaggttctaccagcgaatccccttctggcaccgcaccaggtacttctacccctgaaagcggctccgcttctccaggtagcgaacctgcaacctctggctctgaaaccccaggtacctctgaaagcgctactcctgaatctggcccaggtacttctactgaaccgtccgagggcagcgcaccaggtacttctactgaaccgtctgaaggtagcgcaccaggtacttctgaaagcgcaaccccggaatccggcccaggtacctctgaaagcgcaaccccggagtccggcccaggttcgtcttcactcgagggtaccgaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttctcttatggtgttcaatgcttttcccgttatccggatcacatgaaacggcatgactttttcaagagtgccatgcccgaaggttatgtacaggaacgcactatatctttcaaagatgacgggaactacaagacgcgtgctgaagtcaagtttgaaggtgatacccttgttaatcgtatcgagttaaaaggtattgattttaaagaagatggaaacattctcggacacaaactcgagtacaactataactcacacaatgtatacatcacggcagacaaacaaaagaatggaatcaaagctaacttcaaaattcgccacaacattgaagatggatccgttcaactagcagaccattatcaacaaaatactccaattggcgatggccctgtccttttaccagacaaccattacctgtcgacacaatctgccctttcgaaagatcccaacgaaaagcgtgaccacatggtccttcttgagtttgtaactgctgctgggattggtggctctcatcaccatcaccatcaccatcactaa

SEQ ID NO: 721 - DNA, 1566 bp, Artificial Sequence
  Description of Artificial Sequence: Synthetic polynucleotide
atgaaagggtctccaggtgaggttcaacttcaagaatctggtggtggtctagtacaagccggcgactccctgcgcctgtcttgtctggtctccggtcgttcttttaacagctataccatgggctggttccgccaagctccgggcaaagaacgtgaattcgtagcagctattctctggtctggtcctaccacctactatgctgactctgtaaagggccgtttcactatctcccgtgataacgccaaaaacactgtctatctgcagatgaattctctgaaaccggaggacaccgcagtatactattgcgcagctgcgctgggtgtactggtgctcgctccaggtaatgtatacagctattggggtcaaggtacgcaagtcacggtaagctctgcgcatcatggaggtaccccgggcagcggtaccgcatcttcctctccaggtagctctaccccgtctggtgctaccggttccccaggtagctctaccccgtctggtgcaaccggctccccaggtagcccggctggctctcctacctctactgaggaaggtacttctgaaagcgctactcctgagtctggtccaggtacctctactgaaccgtccgaaggtagcgctccaggttctagcccttctgcatccaccggtaccggcccaggttctagcccgtctgcttctaccggtactggtccaggtgcttctccgggtactagctctactggttctccaggtacctctaccgaaccgtccgagggtagcgcaccaggtacctctactgaaccgtctgagggtagcgctccaggtagcgaaccggcaacctccggttctgaaactccaggttcgtcttcactcgagggtaccgaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttctcttatggtgttcaatgcttttcccgttatccggatcacatgaaacggcatgactttttcaagagtgccatgcccgaaggttatgtacaggaacgcactatatctttcaaagatgacgggaactacaagacgcgtgctgaagtcaagtttgaaggtgatacccttgttaatcgtatcgagttaaaaggtattgattttaaagaagatggaaacattctcggacacaaactcgagtacaactataactcacacaatgtatacatcacggcagacaaacaaaagaatggaatcaaagctaacttcaaaattcgccacaacattgaagatggatccgttcaactagcagaccattatcaacaaaatactccaattggcgatggccctgtccttttaccagacaaccattacctgtcgacacaatctgccctttcgaaagatcccaacgaaaagcgtgaccacatggtccttcttgagtttgtaactgctgctgggattggtggctctcatcaccatcaccatcaccatcactaa

SEQ ID NO: 722 - DNA, 1566 bp, Artificial Sequence
  Description of Artificial Sequence: Synthetic polynucleotide
atgaaagggtctccaggtgaagtgcaacttcaagaatctggtggtggtctggtacaagctggtgactctctgcgcctgtcttgtctggtctccggtcgttccttcaatagctataccatgggctggttccgccaagcgcctggcaaagagcgtgaattcgtagcagcaatcctttggtccggtccaactacctactatgctgactctgtaaaaggtcgcttcaccatctcccgtgataacgccaaaaacactgtttatctacaaatgaattctctgaaaccggaggacacggctgtttactactgtgctgccgcgctgggtgtactggtgctcgcaccaggtaatgtgtacagctattggggtcaaggtacccaggtgacggtcagctctgcgcatcatggaggtagcccggcaggctctccgacctctactgaggaaggtacttctgaaagcgcaaccccggagtccggcccaggtacctctaccgaaccgtctgagggcagcgcaccaggtacttctgaaagcgcaacccctgaatccggtccaggtagcgaaccggctacttctggctctgagactccaggtacttctaccgaaccgtccgaaggtagcgcaccaggtagcccggctggttctccgacttccaccgaggaaggtacctctactgaaccttctgagggtagcgctccaggtacctctactgaaccttccgaaggcagcgctccaggtacttctaccgaaccgtccgagggcagcgctccaggtacttctactgaaccttctgaaggcagcgctccaggtacttctactgaaccttccgaaggtagcgcaccaggttcgtcttcactcgagggtaccgaacttttcactggagttgtcccaattcttgttgaattagatggtgatgttaatgggcacaaattttctgtcagtggagagggtgaaggtgatgcaacatacggaaaacttacccttaaatttatttgcactactggaaaactacctgttccatggccaacacttgtcactactttctcttatggtgttcaatgcttttcccgttatccggatcacatgaaacggcatgactttttcaagagtgccatgcccgaaggttatgtacaggaacgcactatatctttcaaagatgacgggaactacaagacgcgtgctgaagtcaagtttgaaggtgatacccttgttaatcgtatcgagttaaaaggtattgattttaaagaagatggaaacattctcggacacaaactcgagtacaactataactcacacaatgtatacatcacggcagacaaacaaaagaatggaatcaaagctaacttcaaaattcgccacaacattgaagatggatccgttcaactagcagaccattatcaacaaaatactccaattggcgatggccctgtccttttaccagacaaccattacctgtcgacacaatctgccctttcgaaagatcccaacgaaaagcgtgaccacatggtccttcttgagtttgtaactgctgctgggattggtggctctcatcaccatcaccatcaccatcactaa

SEQ ID NO: 723 - protein, 1146 aa, Artificial Sequence
  Description of Artificial Sequence: Synthetic polypeptide
MAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEGAPGTSESATPESGPGSEPATSGSETPGTSTEPSEGSAPGPAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 724 - protein, 1156 aa, Artificial Sequence
  Description of Artificial Sequence: Synthetic polypeptide
MAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSGAPGTSESATPESGPGSEPATSGSETPGTSTEPSEGSAPGPAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 725 - protein, 1262 aa, Artificial Sequence
  Description of Artificial Sequence: Synthetic polypeptide
MAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEGAPSTGGTSESATPESGPGTSTEPSEGSAPGTSTEPSEGSAPGTSESATPESGPGTSTEPSEGSAPGTSTEPSEGSAPGTSESATPESGPGTSTEPSEGSAPGTSTEPSEGSAPGTSTEPSEGSAPGSPAGSPTSTEEGTSTEPSEGSAPGPEPTGPAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 726 - protein, 1272 aa, Artificial Sequence
  Description of Artificial Sequence: Synthetic polypeptide
MAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSGAPSTGGTSESATPESGPGTSTEPSEGSAPGTSTEPSEGSAPGTSESATPESGPGTSTEPSEGSAPGTSTEPSEGSAPGTSESATPESGPGTSTEPSEGSAPGTSTEPSEGSAPGTSTEPSEGSAPGSPAGSPTSTEEGTSTEPSEGSAPGPEPTGPAMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEPCPDSGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 727 - protein, 1173 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGADIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKTGSGEGSEGEGGGEGSEGEGSGEGGEGEGSGSQVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSS

SEQ ID NO: 728 - protein, 1128 aa, Artificial Sequence
  Description of Artificial Sequence: Synthetic polypeptide
MADIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKTGSGEGSEGEGGGEGSEGEGSGEGGEGEGSGSQVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 729 - protein, 1319 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGADIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKTGSGEGSEGEGGGEGSEGEGSGEGGEGEGSGSQVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSGGTSESATPESGPGTSTEPSEGSAPGTSTEPSEGSAPGTSESATPESGPGTSTEPSEGSAPGTSTEPSEGSAPGTSESATPESGPGTSTEPSEGSAPGTSTEPSEGSAPGTSTEPSEGSAPGSPAGSPTSTEEGTSTEPSEGSAPG

SEQ ID NO: 730 - protein, 1177 aa, Artificial Sequence
  Description of Artificial Sequence: Synthetic polypeptide
MAEPAGSPTSTEEGTPGSGTASSSPGSSTPSGATGSPGASPGTSSTGSPGSPGDIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKTGSGEGSEGEGGGEGSEGEGSGEGGEGEGSGSQVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 731 - protein, 1128 aa, Artificial Sequence
  Description of Artificial Sequence: Synthetic polypeptide
MAEIVLTQSPATLSLSPGERATLSCRASQSISDYLHWYQQKPGQAPRLLIYYASHSISGIPARFSGSGSGTDFTLTISSLEPEDFAVYYCQHGHSYPWTFGGGTKVEIKTGSGEGSEGEGGGEGSEGEGSGEGGEGEGSGTQVQLVQSGSELKKPGASVKVSCKASGYAFTTTGMQWVRQAPGQGLEWMGWINTHSGVPKYVEDFKGRFVFSLDTSVSTAYLQISSLKAEDTAVYYCARSGNGNYDLAYFKYWGQGTLVTVSSGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 732 - protein, 1128 aa, Artificial Sequence; identical to SEQ ID NO: 731
  Description of Artificial Sequence: Synthetic polypeptide

SEQ ID NO: 733 - protein, 1174 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGEIVLTQSPATLSLSPGERATLSCRASQSISDYLHWYQQKPGQAPRLLIYYASHSISGIPARFSGSGSGTDFTLTISSLEPEDFAVYYCQHGHSYPWTFGGGTKVEIKTGSGEGSEGEGGGEGSEGEGSGEGGEGEGSGTQVQLVQSGSELKKPGASVKVSCKASGYAFTTTGMQWVRQAPGQGLEWMGWINTHSGVPKYVEDFKGRFVFSLDTSVSTAYLQISSLKAEDTAVYYCARSGNGNYDLAYFKYWGQGTLVTVS

SEQ ID NO: 734 - protein, 1174 aa, Artificial Sequence; identical to SEQ ID NO: 733
  Description of Artificial Sequence: Synthetic polypeptide

SEQ ID NO: 735 - protein, 1127 aa, Artificial Sequence
  Description of Artificial Sequence: Synthetic polypeptide
MEDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKTGSGEGSEGEGGGEGSEGEGSGEGGEGEGSGTEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 736 - protein, 839 aa, Artificial Sequence
  Description of Artificial Sequence: Synthetic polypeptide
MEDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKTGSGEGSEGEGGGEGSEGEGSGEGGEGEGSGTEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 737 - protein, 551 aa, Artificial Sequence
  Description of Artificial Sequence: Synthetic polypeptide
MEDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKTGSGEGSEGEGGGEGSEGEGSGEGGEGEGSGTEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSGSPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 738 - protein, 1176 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSSSLDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKTGSGEGSEGEGGGEGSEGEGSGEGGEGEGSGTEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVS

SEQ ID NO: 739 - protein, 854 aa, Artificial Sequence
  Description of Artificial Sequence: Synthetic polypeptide
MEDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKTGSGEGSEGEGGGEGSEGEGSGEGGEGEGSGTQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSGGEGSGEGSEGEGSEGSGEGEGSEGSGEGEGGSEGSEGEGSEGSGEGEGGEGSGEGEGSGEGSEGEGGGEGSEGEGSGEGGEGEGSEGGSEGEGGSEGGEGEGSEGSGEGEGSEGGSEGEGSEGGSEGEGSEGSGEGEGSEGSGEGEGSEGSGEGEGSEGSGEGEGSEGGSEGEGGSEGSEGEGSGEGSEGEGGSEGSEGEGGGEGSEGEGSGEGSEGEGGSEGSEGEGGSEGSEGEGGEGSGEGEGSEGSGEGEGSGEGSEGEGSEGSGEGEGSEGSGEGEGGSEGSEGEGSGEGSEGEGSEGSGEGEGSEGSGEGEGGSEGSEGEGGSEGSEGEGGSEGSEGEGGEGSGEGEGSEGSGEGEGSGEGSEGEGSEGSGEGEGSEGSGEGEGGSEGSEGEGSEGSGEGEGGEGSGEGEGSGEGSEGEGGGEGSEGEGSEGSGEGEGSEGSGEGEGSEGGSEGEGGSEGSEGEGSEGGSEGEGSEGGSEGEGSEGSGEGEGSEGSGEGEGSGEGSEGEGGSEGGEGEGSEGGSEGEGSEGGSEGEGGEGSGEGEGGGEGSEGEGSEGSGEGEGSGEGSEGDYKDDDDKGGSHHHHHH

SEQ ID NO: 740 - protein, 792 aa, Artificial Sequence
  Description of Artificial Sequence: Synthetic polypeptide
MKDIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITRTGSGEGSEGEGGGEGSEGEGSGEGGEGEGSGTQVQLVQSGGGVVQPGRSLRLSCKASGYTFTRYTMHWVRQAPGKGLEWIGYINPSRGYTNYNQKFKDRFTISTDKSKSTAFLQMDSLRPEDTAVYYSARYYDDHYCLDYWGQGTPVTVSSGGEGSGEGSEGEGSEGSGEGEGSEGSGEGEGGSEGSEGEGGSEGSEGEGGSEGSEGEGSGEGSEGEGGSEGSEGEGSGEGSEGEGSEGGSEGEGGSEGSEGEGSGEGSEGEGGEGGSEGEGSEGSGEGEGSGEGSEGEGSEGSGEGEGSGEGSEGEGSEGSGEGEGSEGSGEGEGGSEGSEGEGSEGSGEGEGGEGSGEGEGSGEGSEGEGGGEGSEGEGSGEGGEGEGSEGGSEGEGGSEGGEGEGSEGSGEGEGSEGGSEGEGSEGGSEGEGSEGSGEGEGSEGSGEGSSSLEGTELFTGVVPILVELDGDVNGHKFSVSGEGEGDATYGKLTLKFICTTGKLPVPWPTLVTTFSYGVQCFSRYPDHMKRHDFFKSAMPEGYVQERTISFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGIGGSHHHHHHHH

SEQ ID NO: 741 - protein, 828 aa, Artificial Sequence
  Description of Artificial Sequence: Synthetic polypeptide
MEDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKTGSGEGSEGEGGGEGSEGEGSGEGGEGEGSGTEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSGGEGSGEGSEGEGSEGSGEGEGSEGSGEGEGGSEGSEGEGGSEGSEGEGGSEGSEGEGSGEGSEGEGGSEGSEGEGSGEGSEGEGSEGGSEGEGGSEGSEGEGSGEGSEGEGGEGGSEGEGSEGSGEGEGSGEGSEGEGSEGSGEGEGSGEGSEGEGSEGSGEGEGSEGSGEGEGGSEGSEGEGSEGSGEGEGGEGSGEGEGSGEGSEGEGGGEGSEGEGSGEGGEGEGSEGGSEGEGGSEGGEGEGSEGSGEGEGSEGGSEGEGSEGGSEGEGSEGSGEGEGSEGSGEGDIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITRTGSGEGSEGEGGGEGSEGEGSGEGGEGEGSGTQVQLVQSGGGVVQPGRSLRLSCKASGYTFTRYTMHWVRQAPGKGLEWIGYINPSRGYTNYNQKFKDRFTISTDKSKSTAFLQMDSLRPEDTAVYYSARYYDDHYCLDYWGQGTPVTVSSGGYPYDVPDYAGGSHHHHHH

SEQ ID NO: 742 - protein, 828 aa, Artificial Sequence
  Description of Artificial Sequence: Synthetic polypeptide
MEDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKTGSGEGSEGEGGGEGSEGEGSGEGGEGEGSGTEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSGGEGSGEGSEGEGSEGSGEGEGSEGSGEGEGGSEGSEGEGGSEGSEGEGGSEGSEGEGSGEGSEGEGGSEGSEGEGSGEGSEGEGSEGGSEGEGGSEGSEGEGSGEGSEGEGGEGGSEGEGSEGSGEGEGSGEGSEGEGSEGSGEGEGSGEGSEGEGSEGSGEGEGSEGSGEGEGGSEGSEGEGSEGSGEGEGGEGSGEGEGSGEGSEGEGGGEGSEGEGSGEGGEGEGSEGGSEGEGGSEGGEGEGSEGSGEGEGSEGGSEGEGSEGGSEGEGSEGSGEGEGSEGSGEGEDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKTGSGEGSEGEGGGEGSEGEGSGEGGEGEGSGTQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSGGYPYDVPDYAGGSHHHHHH

SEQ ID NO: 743 - protein, 842 aa, Artificial Sequence
  Description of Artificial Sequence: Synthetic polypeptide
MEDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKTGSGEGSEGEGGGEGSEGEGSGEGGEGEGSGTEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSGSPGEGSGEGSEGEGSEGSGEGEGSEGSGEGEGGSEGSEGEGGSEGSEGEGGSEGSEGEGSGEGSEGEGGSEGSEGEGSGEGSEGEGSEGGSEGEGGSEGSEGEGSGEGSEGEGGEGGSEGEGSEGSGEGEGSGEGSEGEGSEGSGEGEGSGEGSEGEGSEGSGEGEGSEGSGEGEGGSEGSEGEGSEGSGEGEGGEGSGEGEGSGEGSEGEGGGEGSEGEGSGEGGEGEGSEGGSEGEGGSEGGEGEGSEGSGEGEGSEGGSEGEGSEGGSEGEGSEGSGEGEGSEGSGEGSSSLEGTKDIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITRTGSGEGSEGEGGGEGSEGEGSGEGGEGEGSGTQVQLVQSGGGVVQPGRSLRLSCKASGYTFTRYTMHWVRQAPGKGLEWIGYINPSRGYTNYNQKFKDRFTISTDKSKSTAFLQMDSLRPEDTAVYYSARYYDDHYCLDYWGQGTPVTVSSTSGGYPYDVPDYAGGSHHHHHHHH

SEQ ID NO: 744 - protein, 521 aa, Artificial Sequence
  Description of Artificial Sequence: Synthetic polypeptide
MKGSPGEVQLQESGGGLVQAGDSLRLSCLVSGRSFNSYTMGWFRQAPGKEREFVAAILWSGPTTYYADSVKGRFTISRDNAKNTVYLQMNSLKPEDTAVYYCAAALGVLVLAPGNVYSYWGQGTQVTVSSAHHGGTPGSGTASSSPGSSTPSGATGSPGSSTPSGATGSPGSPAGSPTSTEEGTSESATPESGPGTSTEPSEGSAPGSSPSASTGTGPGSSPSASTGTGPGASPGTSSTGSPGTSTEPSEGSAPGTSTEPSEGSAPGSEPATSGSETPGSSSLEGTELFTGVVPILVELDGDVNGHKFSVSGEGEGDATYGKLTLKFICTTGKLPVPWPTLVTTFSYGVQCFSRYPDHMKRHDFFKSAMPEGYVQERTISFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGIGGSHHHHHHHH

SEQ ID NO: 745 - protein, 521 aa, Artificial Sequence
  Description of Artificial Sequence: Synthetic polypeptide
MKGSPGEVQLQESGGGLVQAGDSLRLSCLVSGRSFNSYTMGWFRQAPGKEREFVAAILWSGPTTYYADSVKGRFTISRDNAKNTVYLQMNSLKPEDTAVYYCAAALGVLVLAPGNVYSYWGQGTQVTVSSAHHGGTSTEPSEGSAPGTSTEPSEGSAPGTSTEPSEGSAPGSTSESPSGTAPGSTSESPSGTAPGTSTPESGSASPGSEPATSGSETPGTSESATPESGPGTSTEPSEGSAPGTSTEPSEGSAPGTSESATPESGPGTSESATPESGPGSSSLEGTELFTGVVPILVELDGDVNGHKFSVSGEGEGDATYGKLTLKFICTTGKLPVPWPTLVTTFSYGVQCFSRYPDHMKRHDFFKSAMPEGYVQERTISFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGIGGSHHHHHHHH

SEQ ID NO: 746 - protein, 521 aa, Artificial Sequence; identical to SEQ ID NO: 744
  Description of Artificial Sequence: Synthetic polypeptide

SEQ ID NO: 747 - protein, 521 aa, Artificial Sequence
  Description of Artificial Sequence: Synthetic polypeptide
MKGSPGEVQLQESGGGLVQAGDSLRLSCLVSGRSFNSYTMGWFRQAPGKEREFVAAILWSGPTTYYADSVKGRFTISRDNAKNTVYLQMNSLKPEDTAVYYCAAALGVLVLAPGNVYSYWGQGTQVTVSSAHHGGSPAGSPTSTEEGTSESATPESGPGTSTEPSEGSAPGTSESATPESGPGSEPATSGSETPGTSTEPSEGSAPGSPAGSPTSTEEGTSTEPSEGSAPGTSTEPSEGSAPGTSTEPSEGSAPGTSTEPSEGSAPGTSTEPSEGSAPGSSSLEGTELFTGVVPILVELDGDVNGHKFSVSGEGEGDATYGKLTLKFICTTGKLPVPWPTLVTTFSYGVQCFSRYPDHMKRHDFFKSAMPEGYVQERTISFKDDGNYKTRAEVKFEGDTLVNRIELKGIDFKEDGNILGHKLEYNYNSHNVYITADKQKNGIKANFKIRHNIEDGSVQLADHYQQNTPIGDGPVLLPDNHYLSTQSALSKDPNEKRDHMVLLEFVTAAGIGGSHHHHHHHH

SEQ ID NO: 748 - protein, 7 aa, Artificial Sequence
  Description of Artificial Sequence: Synthetic peptide
KLTRAET

SEQ ID NO: 749 - protein, 8 aa, Artificial Sequence
  Description of Artificial Sequence: Synthetic peptide
LGPVSGVP

SEQ ID NO: 750 - protein, 8 aa, Artificial Sequence
  Description of Artificial Sequence: Synthetic peptide
GPAGLGGA

SEQ ID NO: 751 - protein, 8 aa, Artificial Sequence
  Description of Artificial Sequence: Synthetic peptide
GPAGLRGA

SEQ ID NO: 752 - protein, 8 aa, Artificial Sequence
  Description of Artificial Sequence: Synthetic peptide
APLGLRLR

SEQ ID NO: 753 - protein, 8 aa, Artificial Sequence
  Description of Artificial Sequence: Synthetic peptide
PALPLVAQ

SEQ ID NO: 754 - protein, 36 aa, Artificial Sequence; identical to SEQ ID NO: 318
  Description of Artificial Sequence: Synthetic polypeptide

SEQ ID NO: 755 - protein, 36 aa, Artificial Sequence; identical to SEQ ID NO: 319
  Description of Artificial Sequence: Synthetic polypeptide

SEQ ID NO: 756 - protein, 36 aa, Artificial Sequence; identical to SEQ ID NO: 496
  Description of Artificial Sequence: Synthetic polypeptide

SEQ ID NO: 757 - protein, 36 aa, Artificial Sequence; identical to SEQ ID NO: 497
  Description of Artificial Sequence: Synthetic polypeptide

SEQ ID NO: 758 - protein, 42 aa, Artificial Sequence; identical to SEQ ID NO: 32
  Description of Artificial Sequence: Synthetic polypeptide

SEQ ID NO: 759 - protein, 42 aa, Artificial Sequence; identical to SEQ ID NO: 32
  Description of Artificial Sequence: Synthetic polypeptide

SEQ ID NO: 760 - protein, 42 aa, Artificial Sequence; identical to SEQ ID NO: 35
  Description of Artificial Sequence: Synthetic polypeptide

SEQ ID NO: 761 - protein, 42 aa, Artificial Sequence; identical to SEQ ID NO: 36
  Description of Artificial Sequence: Synthetic polypeptide

SEQ ID NO: 762 - protein, 144 aa, Artificial Sequence; identical to SEQ ID NO: 41
  Description of Artificial Sequence: Synthetic polypeptide

SEQ ID NO: 763 - protein, 144 aa, Artificial Sequence; identical to SEQ ID NO: 43
  Description of Artificial Sequence: Synthetic polypeptide

SEQ ID NO: 764 - protein, 288 aa, Artificial Sequence; identical to SEQ ID NO: 47
  Description of Artificial Sequence: Synthetic polypeptide

SEQ ID NO: 765 - protein, 288 aa, Artificial Sequence; identical to SEQ ID NO: 50
  Description of Artificial Sequence: Synthetic polypeptide

SEQ ID NO: 766 - protein, 504 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSP

SEQ ID NO: 767 - protein, 576 aa, Artificial Sequence; identical to SEQ ID NO: 53
  Description of Artificial Sequence: Synthetic polypeptide

SEQ ID NO: 768 - protein, 576 aa, Artificial Sequence; identical to SEQ ID NO: 54
  Description of Artificial Sequence: Synthetic polypeptide

SEQ ID NO: 769 - protein, 576 aa, Artificial Sequence; identical to SEQ ID NO: 56
  Description of Artificial Sequence: Synthetic polypeptide

SEQ ID NO: 770 - protein, 540 aa, Artificial Sequence; identical to SEQ ID NO: 52
  Description of Artificial Sequence: Synthetic polypeptide

SEQ ID NO: 771 - protein, 836 aa, Artificial Sequence; identical to SEQ ID NO: 58
  Description of Artificial Sequence: Synthetic polypeptide

SEQ ID NO: 772 - protein, 864 aa, Artificial Sequence; identical to SEQ ID NO: 59
  Description of Artificial Sequence: Synthetic polypeptide

SEQ ID NO: 773 - protein, 875 aa, Artificial Sequence; identical to SEQ ID NO: 60
  Description of Artificial Sequence: Synthetic polypeptide
  MOD_RES (430)..(432): Any amino acid
  MOD_RES (443)..(446): Any amino acid

SEQ ID NO: 774 - protein, 864 aa, Artificial Sequence; identical to SEQ ID NO: 61
  Description of Artificial Sequence: Synthetic polypeptide

SEQ ID NO: 775 - protein, 875 aa, Artificial Sequence; identical to SEQ ID NO: 62
  Description of Artificial Sequence: Synthetic polypeptide

SEQ ID NO: 776 - protein, 1318 aa, Artificial Sequence; identical to SEQ ID NO: 65
  Description of Artificial Sequence: Synthetic polypeptide

SEQ ID NO: 777 - protein, 924 aa, Artificial Sequence; identical to SEQ ID NO: 64
  Description of Artificial Sequence: Synthetic polypeptide

SEQ ID NO: 778 - protein, 913 aa, Artificial Sequence; identical to SEQ ID NO: 63
  Description of Artificial Sequence: Synthetic polypeptide

SEQ ID NO: 779 - protein, 864 aa, Artificial Sequence; identical to SEQ ID NO: 66
  Description of Artificial Sequence: Synthetic polypeptide

SEQ ID NO: 780 - protein, 4 aa, Artificial Sequence
  Description of Artificial Sequence: Synthetic peptide
GGSG

SEQ ID NO: 781 - protein, 288 aa, Artificial Sequence
  Description of Artificial Sequence: Synthetic polypeptide
GSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEGGSGGEG

SEQ ID NO: 782 - protein, 288 aa, Artificial Sequence
  Description of Artificial Sequence: Synthetic polypeptide
GEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEGGEGEGGGEG

SEQ ID NO: 783 - protein, 288 aa, Artificial Sequence
  Description of Artificial Sequence: Synthetic polypeptide
SSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSESSSESSESSSSES

SEQ ID NO: 784 - protein, 288 aa, Artificial Sequence
  Description of Artificial Sequence: Synthetic polypeptide
GEGSGEGSEGEGSEGSGEGEGSEGSGEGEGGSEGSEGEGGSEGSEGEGGSEGSEGEGSGEGSEGEGGSEGSEGEGSGEGSEGEGSEGGSEGEGGSEGSEGEGSGEGSEGEGGEGGSEGEGSEGSGEGEGSGEGSEGEGSEGSGEGEGSGEGSEGEGSEGSGEGEGSEGSGEGEGGSEGSEGEGSEGSGEGEGGEGSGEGEGSGEGSEGEGGGEGSEGEGSGEGGEGEGSEGGSEGEGGSEGGEGEGSEGSGEGEGSEGGSEGEGSEGGSEGEGSEGSGEGEGSEGSGE

SEQ ID NO: 785 - protein, 576 aa, Artificial Sequence
  Description of Artificial Sequence: Synthetic polypeptide
GGKPGEGGKPEGGGGKPGGKPEGEGEGKPGGKPEGGGKPGGGEGGKPEGGKPEGEGKPGGGEGKPGGKPEGGGGKPEGEGKPGGGGGKPGGKPEGEGKPGGGEGGKPEGKPGEGGEGKPGGKPEGGGEGKPGGGKPGEGGKPGEGKPGGGEGGKPEGGKPEGEGKPGGGEGKPGGKPGEGGKPEGGGEGKPGGKPGEGGEGKPGGGKPEGEGKPGGGKPGGGEGGKPEGEGKPGGKPEGGGEGKPGGKPEGGGKPEGGGEGKPGGGKPGEGGKPGEGEGKPGGKPEGEGKPGGEGGGKPEGKPGGGEGGKPEGGKPGEGGKPEGGKPGEGGEGKPGGGKPGEGGKPEGGGKPEGEGKPGGGGKPGEGGKPEGGKPEGGGEGKPGGGKPEGEGKPGGGEGKPGGKPEGGGGKPGEGGKPEGGKPGGEGGGKPEGEGKPGGKPGEGGGGKPGGKPEGEGKPGEGGEGKPGGKPEGGGEGKPGGKPEGGGEGKPGGGKPGEGGKPEGGGKPGEGGKPGEGGKPEGEGKPGGGEGKPGGKPGEGGKPEGGGEGKPGGKPGGEGGGKPEGGKPGEGGKPEG

SEQ ID NO: 786 - protein, 558 aa, Artificial Sequence
  Description of Artificial Sequence: Synthetic polypeptide
GEGKPGGKPGSGGGKPGEGGKPGSGEGKPGGKPGSGGSGKPGGKPGEGGKPEGGSGGKPGGGGKPGGKPGGEGSGKPGGKPEGGGKPEGGSGGKPGGKPEGGSGGKPGGKPGSGEGGKPGGGKPGGEGKPGSGKPGGEGSGKPGGKPEGGSGGKPGGKPEGGSGGKPGGSGKPGGKPGEGGKPEGGSGGKPGGSGKPGGKPEGGGSGKPGGKPGEGGKPGSGEGGKPGGGKPGGEGKPGSGKPGGEGSGKPGGKPGSGGEGKPGGKPEGGSGGKPGGGKPGGEGKPGSGGKPGEGGKPGSGGGKPGGKPGGEGEGKPGGKPGEGGKPGGEGSGKPGGGGKPGGKPGGEGGKPEGSGKPGGGSGKPGGKPEGGGGKPEGSGKPGGGGKPEGSGKPGGGKPEGGSGGKPGGSGKPGGKPGEGGGKPEGSGKPGGGSGKPGGKPEGGGKPEGGSGGKPGGKPEGGSGGKPGGKPGGEGSGKPGGKPGSGEGGKPGGKPGEGSGGKPGGKPEGGSGGKPGGSGKPGGKPEGGGSGKPGGKPGEGGKPGGEGSGKPGGSGKPG

SEQ ID NO: 787 - protein, 577 aa, Artificial Sequence
  Description of Artificial Sequence: Synthetic polypeptide
GGSGKPGKPGGSGSGKPGSGKPGGGSGKPGSGKPGGGSGKPGSGKPGGGSGKPGSGKPGGGGKPGSGSGKPGGGKPGGSGGKPGGGSGKPGKPGSGGSGKPGSGKPGGGSGGKPGKPGSGGSGGKPGKPGSGGGSGKPGKPGSGGSGGKPGKPGSGGSGGKPGKPGSGGSGKPGSGKPGGGSGKPGSGKPGSGGSGKPGKPGSGGSGKPGSGKPGSGSGKPGSGKPGGGSGKPGSGKPGSGGSGKPGKPGSGGGKPGSGSGKPGGGKPGSGSGKPGGGKPGGSGGKPGGSGGKPGKPGSGGGSGKPGKPGSGGGSGKPGKPGGSGSGKPGSGKPGGGSGKPGSGKPGSGGSGKPGKPGSGGSGGKPGKPGSGGGKPGSGSGKPGGGKPGSGSGKPGGGKPGSGSGKPGGGKPGSGSGKPGGSGKPGSGKPGGGSGGKPGKPGSGGSGKPGSGKPGSGGSGKPGKPGGSGSGKPGSGKPGGGSGKPGSGKPGGGSGKPGSGKPGGGSGKPGSGKPGGGGKPGSGSGKPGGSGGKPGKPGSGGSGGKPGKPGSGGSGKPGSGKPGGGSGGKPGKPGSGG

SEQ ID NO: 788 - protein, 576 aa, Artificial Sequence
  Description of Artificial Sequence: Synthetic polypeptide
GEGSGEGSEGEGSEGSGEGEGSEGSGEGEGGSEGSEGEGSEGSGEGEGGEGSGEGEGSGEGSEGEGGGEGSEGEGSGEGGEGEGSEGGSEGEGGSEGGEGEGSEGSGEGEGSEGGSEGEGSEGGSEGEGSEGSGEGEGSEGSGEGEGSEGSGEGEGSEGSGEGEGSEGGSEGEGGSEGSEGEGSGEGSEGEGGSEGSEGEGGGEGSEGEGSGEGSEGEGGSEGSEGEGGSEGSEGEGGEGSGEGEGSEGSGEGEGSGEGSEGEGSEGSGEGEGSEGSGEGEGGSEGSEGEGSGEGSEGEGSEGSGEGEGSEGSGEGEGGSEGSEGEGGSEGSEGEGGSEGSEGEGGEGSGEGEGSEGSGEGEGSGEGSEGEGSEGSGEGEGSEGSGEGEGGSEGSEGEGSEGSGEGEGGEGSGEGEGSGEGSEGEGGGEGSEGEGSEGSGEGEGSEGSGEGEGSEGGSEGEGGSEGSEGEGSEGGSEGEGSEGGSEGEGSEGSGEGEGSEGSGEGEGSGEGSEGEGGSEGGEGEGSEGGSEGEGSEGGSEGEGGEGSGEGEGGGEGSEGEGSEGSGEGEGSGEGSE

SEQ ID NO: 789 - protein, 576 aa, Artificial Sequence; identical to SEQ ID NO: 53
  Description of Artificial Sequence: Synthetic polypeptide

SEQ ID NO: 790 - protein, 577 aa, Artificial Sequence
  Description of Artificial Sequence: Synthetic polypeptide
AGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 791 - protein, 540 aa, Artificial Sequence; identical to SEQ ID NO: 52
  Description of Artificial Sequence: Synthetic polypeptide

SEQ ID NO: 792 - protein, 504 aa, Artificial Sequence; identical to SEQ ID NO: 766
  Description of Artificial Sequence: Synthetic polypeptide

SEQ ID NO: 793 - protein, 816 aa, Artificial Sequence
  Description of Artificial Sequence: Synthetic polypeptide
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAP

SEQ ID NO: 794 - protein, 875 aa, Artificial Sequence; identical to SEQ ID NO: 60
  Description of Artificial Sequence: Synthetic polypeptide
  MOD_RES (430)..(432): Any amino acid
  MOD_RES (443)..(446): Any amino acid

SEQ ID NO: 795 - protein, 868 aa, Artificial Sequence
  Description of Artificial Sequence: Synthetic polypeptide
GGSPGASPGTSSTGSPGSSPSASTGTGPGSSPSASTGTGPGTPGSGTASSSPGSSTPSGATGSPGSNPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSNPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSASTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 796 - protein, 875 aa, Artificial Sequence; identical to SEQ ID NO: 62
  Description of Artificial Sequence: Synthetic polypeptide

SEQ ID NO: 797 - protein, 1318 aa, Artificial Sequence; identical to SEQ ID NO: 65
  Description of Artificial Sequence: Synthetic polypeptide

SEQ ID NO: 798 - protein, 9 aa, Artificial Sequence
  Description of Artificial Sequence: Synthetic peptide
FDKLPRTSG

SEQ ID NO: 799 - protein, 7 aa, Artificial Sequence
  Description of Artificial Sequence: Synthetic peptide
FKLMVWY

SEQ ID NO: 800 - DNA, 3183 bp, Artificial Sequence
  Description of Artificial Sequence: Synthetic polynucleotide
atggcaaatacaccggtatcaggcaatttgaaggttgaattctacaacagcaatccttcagatactactaactcaatcaatcctcagttcaaggttactaataccggaagcagtgcaattgatttgtccaaactcacattgagatattattatacagtagacggacagaaagatcagaccttctgggctgaccatgctgcaataatcggcagtaacggcagctacaacggaattacttcaaatgtaaaaggaacatttgtaaaaatgagttcctcaacaaataacgcagacacctaccttgaaatcagctttacaggcggaactcttgaaccgggtgcacatgttcagatacaaggtagatttgcaaagaatgactggagtaactatacacagtcaaatgactactcattcaagtctgcttcacagtttgttgaatgggatcaggtaacagcatacttgaacggtgttcttgtatggggtaaagaacccggtggcagtgtagtaggttcaggttcaggatccgaaaatctgtattttcagggtgggtctccaggtagcccggctggctctcctacctctactgaggaaggtacttctgaaagcgctactcctgagtctggtccaggtacctctactgaaccgtccgaaggtagcgctccaggtagcccagcaggctctccgacttccactgaggaaggtacttctactgaaccttccgaaggcagcgcaccaggtacctctactgaaccttctgagggcagcgctccaggtacttctgaaagcgctaccccggaatctggcccaggtagcgaaccggctacttctggttctgaaaccccaggtagcgaaccggctacctccggttctgaaactccaggtagcccggcaggctctccgacctctactgaggaaggtacttctgaaagcgcaaccccggagtccggcccaggtacctctaccgaaccgtctgagggcagcgcaccaggtacttctaccgaaccgtccgagggtagcgcaccaggtagcccagcaggttctcctacctccaccgaggaaggtacttctaccgaaccgtccgagggtagcgcaccaggtacctctactgaaccttctgagggcagcgctccaggtacttctgaaagcgctaccccggagtccggtccaggtacttctactgaaccgtccgaaggtagcgcaccaggtacttctgaaagcgcaacccctgaatccggtccaggtagcgaaccggctacttctggctctgagactccaggtacttctaccgaaccgtccgaaggtagcgcaccaggtacttctactgaaccgtctgaaggtagcgcaccaggtacttctgaaagcgcaaccccggaatccggcccaggtacctctgaaagcgcaaccccggagtccggcccaggtagccctgctggctctccaacctccaccgaagaaggtacctctgaaagcgcaacccctgaatccggcccaggtagcgaaccggcaacctccggttctgaaaccccaggtacctctgaaagcgctactccggagtctggcccaggtacctctactgaaccgtctgagggtagcgctccaggtacttctactgaaccgtccgaaggtagcgcaccaggtacttctaccgaaccgtccgaaggcagcgctccaggtacctctactgaaccttccgagggcagcgctccaggtacctctaccgaaccttctgaaggtagcgcaccaggtacttctaccgaaccgtccgagggtagcgcaccaggtagcccagcaggttctcctacctccaccgaggaaggtacttctaccgaaccgtccgagggtagcgcaccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtacttctgaaagcgctactcctgagtccggcccaggtagcccggctggctctccgacttccaccgaggaaggtagcccggctggctctccaacttctactgaagaaggtagcccggcaggctctccgacctctactgaggaaggtacttctgaaagcgcaaccccggagtccggcccaggtacctctaccgaaccgtctgagggcagcgcaccaggtggtagcccggctggctcttgtacctctccaggtacctctgaaagcgcaactcctgagtctggcccaggtagcgaacctgctacctccggctctgagactccaggtacctctgaaagcgcaaccccggaatctggtccaggtagcgaacctgcaacctctggctctgaaaccccaggtacctctgaaagcgctactcctgaatctggcccaggtacttctactgaaccgtccgagggcagcgcaccaggtagccctgctggctctccaacctccaccgaagaaggtacctctgaaagcgcaacccctgaatccggcccaggtagcgaaccggcaacctccggttctgaaaccccaggtacttctgaaagcgctactcctgagtccggcccaggtagcccggctggctctccgacttccaccgaggaaggtagcccggctggctctccaacttctactgaagaaggtacttctaccgaaccttccgagggcagcgcaccaggtacttctgaaagcgctacccctgagtccggcccaggtacttctgaaagcgctactcctgaatccggtccaggtacttctgaaagcgctaccccggaatctggcccaggtagcgaaccggctacttctggttctgaaaccccaggtagcgaaccggctacctccggttctgaaactccaggtagcccagcaggctctccgacttccactgaggaaggtacttctactgaaccttccgaaggcagcgcaccaggtacctctactgaaccttctgagggcagcgctccaggtagcgaacctgcaacctctggctctgaaaccccaggtacctctgaaagcgctactcctgaatctggcccaggtacttctactgaaccgtccgagggcagcgcaccaggttaa

SEQ ID NO: 801 - protein, 1060 aa, Artificial Sequence
  Description of Artificial Sequence: Synthetic polypeptide
MANTPVSGNLKVEFYNSNPSDTTNSINPQFKVTNTGSSAIDLSKLTLRYYYTVDGQKDQTFWADHAAIIGSNGSYNGITSNVKGTFVKMSSSTNNADTYLEISFTGGTLEPGAHVQIQGRFAKNDWSNYTQSNDYSFKSASQFVEWDQVTAYLNGVLVWGKEPGGSVVGSGSGSENLYFQGGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGGSPAGSCTSPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 802 - protein, 994 aa, Artificial Sequence
  Description of Artificial Sequence: Synthetic polypeptide
MHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAP

SEQ ID NO: 803 - protein, 1033 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGMHVAQPAVVLASSRGIASFVCEYASPGKATEVRVTVLRQADSQVTEVCAATYMMGNELTFLDDSICTGTSSGNQVNLTIQGLRAMDTGLYICKVELMYPPPYYLGIGNGTQIYVIDPEG

SEQ ID NO: 804 - protein, 1146 aa, Artificial Sequence; identical to SEQ ID NO: 723
  Description of Artificial Sequence: Synthetic polypeptide

SEQ ID NO: 805 - protein, 1262 aa, Artificial Sequence; identical to SEQ ID NO: 725
  Description of Artificial Sequence: Synthetic polypeptide

SEQ ID NO: 806 - protein, 1272 aa, Artificial Sequence; identical to SEQ ID NO: 726
  Description of Artificial Sequence: Synthetic polypeptide

SEQ ID NO: 807 - protein, 1173 aa, Artificial Sequence; identical to SEQ ID NO: 727
  Description of Artificial Sequence: Synthetic polypeptide

SEQ ID NO: 808 - protein, 1128 aa, Artificial Sequence; identical to SEQ ID NO: 728
  Description of Artificial Sequence: Synthetic polypeptide

SEQ ID NO: 809 - protein, 1292 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGADIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKTGSGEGSEGEGGGEGSEGEGSGEGGEGEGSGSQVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSGGTSESATPESGPGTSTEPSEGSAPGTSTEPSEGSAPGTSESATPESGPGTSTEPSEGSAPGTSTEPSEGSAPGTSESATPESGPGTSTEPSEGSAPGTSTEPSEGSAPGTSTEPSEGS

SEQ ID NO: 810 - protein, 1177 aa, Artificial Sequence; identical to SEQ ID NO: 730
  Description of Artificial Sequence: Synthetic polypeptide

SEQ ID NO: 811 - protein, 1249 aa, Artificial Sequence
  Description of Artificial Sequence: Synthetic polypeptide
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGQVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPG

SEQ ID NO: 812 - protein, 1298 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGQVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGDIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKG

SEQ ID NO: 813 - protein, 848 aa, Artificial Sequence
  Description of Artificial Sequence: Synthetic polypeptide
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKGGAPGTSESATPESGPGSEPATSGSETPGTSTEPSEGSAPGPAGQVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSG

SEQ ID NO: 814 - protein, 1324 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGQVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSGGAPSTGGTSESATPESGPGTSTEPSEGSAPGTSTEPSEGSAPGTSESATPESGPGTSTEPSEGSAPGTSTEPSEGSAPGTSESATPESGPGTSTEPSEGSAPGTSTEPSEGSAPGTSTEPSEGSAPGSPAGSPTSTEEGTSTEPSEGSAPGPEPTGPAGQVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSG

SEQ ID NO: 815 - protein, 1147 aa, Artificial Sequence
  Description of Artificial Sequence: Synthetic polypeptide
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKGGAPGTSESATPESGPGSEPATSGSETPGTSTEPSEGSAPGPAGQVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPG

SEQ ID NO: 816 - protein, 1198 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGQVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSGGAPGTSESATPESGPGSEPATSGSETPGTSTEPSEGSAPGPAGMAEIVLTQSPATLSLSPGERATLSCRASQSISDYLHWYQQKPGQAPRLLIYYASHSISGIPARFSGSGSGTDFTLTISSLEPEDFAVYYCQHGHSYPWTFGGGTKVEIKG

SEQ ID NO: 817 - protein, 1580 aa, Artificial Sequence
  Description of Artificial Sequence: Synthetic polypeptide
DIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKGTGSGEGSEGEGGGEGSEGEGSGEGGEGEGSGSGQVQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPG

SEQ ID NO: 818 - protein, 1128 aa, Artificial Sequence; identical to SEQ ID NO: 731
  Description of Artificial Sequence: Synthetic polypeptide

SEQ ID NO: 819 - protein, 1174 aa, Artificial Sequence; identical to SEQ ID NO: 733
  Description of Artificial Sequence: Synthetic polypeptide

SEQ ID NO: 820 - protein, 1292 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGQVQLVQSGSELKKPGASVKVSCKASGYAFTTTGMQWVRQAPGQGLEWMGWINTHSGVPKYVEDFKGRFVFSLDTSVSTAYLQISSLKAEDTAVYYCARSGNGNYDLAYFKYWGQGTLVTVSSGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGMAEIVLTQSPATLSLSPGERATLSCRASQSISDYLHWYQQKPGQAPRLLIYYASHSISGIPARFSGSGSGTDFTLTISSLEPEDFAVYYCQHGHSYPWTFGGGTKVEIKG

SEQ ID NO: 821 - protein, 955 aa, Artificial Sequence
  Description of Artificial Sequence: Synthetic polypeptide
MAEIVLTQSPATLSLSPGERATLSCRASQSISDYLHWYQQKPGQAPRLLIYYASHSISGIPARFSGSGSGTDFTLTISSLEPEDFAVYYCQHGHSYPWTFGGGTKVEIKGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGQVQLVQSGSELKKPGASVKVSCKASGYAFTTTGMQWVRQAPGQGLEWMGWINTHSGVPKYVEDFKGRFVFSLDTSVSTAYLQISSLKAEDTAVYYCARSGNGNYDLAYFKYWGQGTLVTVSSGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPG

SEQ ID NO: 822 - protein, 1141 aa, Artificial Sequence
  Description of Artificial Sequence: Synthetic polypeptide
MAEIVLTQSPATLSLSPGERATLSCRASQSISDYLHWYQQKPGQAPRLLIYYASHSISGIPARFSGSGSGTDFTLTISSLEPEDFAVYYCQHGHSYPWTFGGGTKVEIKGGAPGTSESATPESGPGSEPATSGSETPGTSTEPSEGSAPGPAGQVQLVQSGSELKKPGASVKVSCKASGYAFTTTGMQWVRQAPGQGLEWMGWINTHSGVPKYVEDFKGRFVFSLDTSVSTAYLQISSLKAEDTAVYYCARSGNGNYDLAYFKYWGQGTLVTVSSGGTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSAG

SEQ ID NO: 823 - protein, 1956 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGQVQLVQSGSELKKPGASVKVSCKASGYAFTTTGMQWVRQAPGQGLEWMGWINTHSGVPKYVEDFKGRFVFSLDTSVSTAYLQISSLKAEDTAVYYCARSGNGNYDLAYFKYWGQGTLVTVSSGGAPGTSESATPESGPGSEPATSGSETPGTSTEPSEGSAPGPAGGSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETAG

SEQ ID NO: 824 - protein, 843 aa, Artificial Sequence
  Description of Artificial Sequence: Synthetic polypeptide
MAEIVLTQSPATLSLSPGERATLSCRASQSISDYLHWYQQKPGQAPRLLIYYASHSISGIPARFSGSGSGTDFTLTISSLEPEDFAVYYCQHGHSYPWTFGGGTKVEIKGTGSGEGSEGEGGGEGSEGEGSGEGGEGEGSGSGQVQLVQSGSELKKPGASVKVSCKASGYAFTTTGMQWVRQAPGQGLEWMGWINTHSGVPKYVEDFKGRFVFSLDTSVSTAYLQISSLKAEDTAVYYCARSGNGNYDLAYFKYWGQGTLVTVSSGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPG

SEQ ID NO: 825 - protein, 1292 aa, Artificial Sequence; identical to SEQ ID NO: 820
  Description of Artificial Sequence: Synthetic polypeptide

SEQ ID NO: 826 - protein, 955 aa, Artificial Sequence; identical to SEQ ID NO: 821
  Description of Artificial Sequence: Synthetic polypeptide

SEQ ID NO: 827 - protein, 1127 aa, Artificial Sequence; identical to SEQ ID NO: 735
  Description of Artificial Sequence: Synthetic polypeptide

SEQ ID NO: 828 - protein, 1176 aa, Artificial Sequence; identical to SEQ ID NO: 738
  Description of Artificial Sequence: Synthetic polypeptide

SEQ ID NO: 829 - protein, 1592 aa, Artificial Sequence
  Description of Artificial Sequence: Synthetic polypeptide
MEDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGAPGTSESATPESGPGSEPATSGSETPGTSTEPSEGSAPGPAGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPG

SEQ ID NO: 830 - protein, 1289 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGMEDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSG

SEQ ID NO: 831 - protein, 1002 aa, Artificial Sequence
  Description of Artificial Sequence: Synthetic polypeptide
MAEPAGSPTSTEEGTPGSGTASSSPGSSTPSGATGSPGASPGTSSTGSPGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGMEDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPG

SEQ ID NO: 832 - protein, 1096 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGMEDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGSTSSTAESPGPGSTSSTAESPGPGSTSESPSGTAPGSTSSTAESPGPGSTSSTAESPGPGTSTPESGSASPGSTSESPSGTAPGTSPSGESSTAPGSTSESPSGTAPGSTSESPSGTAPGTSPSGESSTAPGSTSESPSGTAPGSTSESPSGTAPGTSPSGESSTAPGSTSESPSGTAPGSTSESPSGTAPGSTSESPSGTAPGTSTPESGSASPGSTSESPSGTAPGTSTPESGSASPGSTSSTAESPGPGSTSSTAESPGPGTSTPESGSASPGTSTPESGSASPGSTSESPSGTAPGTSTPESGSASPGTSTPESGSASPGSTSESPSGTAPGSTSESPSGTAPGSTSESPSGTAPGSTSSTAESPGPGTSTPESGSASPGTSTPESGSASPGSTSESPSGTAPGSTSESPSGTAPGTSTPESGSASPGSTSESPSGTAPGSTSESPSGTAPGTSTPESGSASPGTSPSGESSTAPGSTSSTAESPGPGTSPSGESSTAPGSTSSTAESPGPGTSTPESGSASPGSTSESPSGTAPGSTSSTAESPGPGTSTPESGSASPGTSTPESGSASPG

SEQ ID NO: 833 - protein, 837 aa, Artificial Sequence
  Description of Artificial Sequence: Synthetic polypeptide
MEDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKTGSGEGSEGEGGGEGSEGEGSGEGGEGEGSGTQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSGGEGSGEGSEGEGSEGSGEGEGSEGSGEGEGGSEGSEGEGSEGSGEGEGGEGSGEGEGSGEGSEGEGGGEGSEGEGSGEGGEGEGSEGGSEGEGGSEGGEGEGSEGSGEGEGSEGGSEGEGSEGGSEGEGSEGSGEGEGSEGSGEGEGSEGSGEGEGSEGSGEGEGSEGGSEGEGGSEGSEGEGSGEGSEGEGGSEGSEGEGGGEGSEGEGSGEGSEGEGGSEGSEGEGGSEGSEGEGGEGSGEGEGSEGSGEGEGSGEGSEGEGSEGSGEGEGSEGSGEGEGGSEGSEGEGSGEGSEGEGSEGSGEGEGSEGSGEGEGGSEGSEGEGGSEGSEGEGGSEGSEGEGGEGSGEGEGSEGSGEGEGSGEGSEGEGSEGSGEGEGSEGSGEGEGGSEGSEGEGSEGSGEGEGGEGSGEGEGSGEGSEGEGGGEGSEGEGSEGSGEGEGSEGSGEGEGSEGGSEGEGGSEGSEGEGSEGGSEGEGSEGGSEGEGSEGSGEGEGSEGSGEGEGSGEGSEGEGGSEGGEGEGSEGGSEGEGSEGGSEGEGGEGSGEGEGGGEGSEGEGSEGSGEGEGSGEGSEG

SEQ ID NO: 834 - protein, 1109 aa, Artificial Sequence
  Description of Artificial Sequence: Synthetic polypeptide
MEDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGAPGTSESATPESGPGSEPATSGSETPGTSTEPSEGSAPGPAGQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSGGSSESGSSEGGPGSSESGSSEGGPGESPGGSSGSESGSGGEPSESGSSGESPGGSSGSESGESPGGSSGSESGSSESGSSEGGPGSSESGSSEGGPGSSESGSSEGGPGESPGGSSGSESGESPGGSSGSESGESPGGSSGSESGSSESGSSEGGPGSSESGSSEGGPGSSESGSSEGGPGSSESGSSEGGPGSSESGSSEGGPGSSESGSSEGGPGSGGEPSESGSSGESPGGSSGSESGESPGGSSGSESGSGGEPSESGSSGSEGSSGPGESSGSSESGSSEGGPGSGGEPSESGSSGSEGSSGPGESSGSSESGSSEGGPGSGGEPSESGSSGESPGGSSGSESGSGGEPSESGSSGSGGEPSESGSSGSSESGSSEGGPGSGGEPSESGSSGSGGEPSESGSSGSEGSSGPGESSGESPGGSSGSESGSEGSSGPGESSGSEGSSGPGESSGSGGEPSESGSSGSSESGSSEGGPGSSESGSSEGGPGESPGGSSGSESGSGGEPSESGSSGSEGSSGPGESSGESPGGSSGSESGSEGSSGPGSSESGSSEGGPGSGGEPSESGSSGSEGSSGPGESSGSEGSSGPGESSGSEGSSGPGESSGSGGEPSESGSSGSGGEPSESGSSGESPGGSSGSESGESPGGSSGSESGSGGEPSESGSSGSEGSSGPGESSGESPGGSSGSESGSSESGSSEGGPGSSESGSSEGGPGSSESGSSEGGPGSGGEPSESGSSGSSESGSSEGGPGESPGGSSGSESGSGGEPSESGSSGSSESGSSEGGPGESPGGSSGSESGSGGEPSESGSSGESPGGSSGSESGSGGEPSESGSSG

SEQ ID NO: 835 - protein, 1313 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGMEDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGAPSTGGTSESATPESGPGTSTEPSEGSAPGTSTEPSEGSAPGTSESATPESGPGTSTEPSEGSAPGTSTEPSEGSAPGTSESATPESGPGTSTEPSEGSAPGTSTEPSEGSAPGTSTEPSEGSAPGSPAGSPTSTEEGTSTEPSEGSAPGPEPTGPAGQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSG

SEQ ID NO: 836 - protein, 1250 aa, Artificial Sequence
  Description of Artificial Sequence: Synthetic polypeptide
  MOD_RES (804)..(806): Any amino acid
  MOD_RES (817)..(820): Any amino acid
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGMEDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGSTSESPSGTAPGTSPSGESSTAPGSTSESPSGTAPGSTSESPSGTAPGTSTPESGSASPGTSTPESGSASPGSTSESPSGTAPGSTSESPSGTAPGTSPSGESSTAPGSTSESPSGTAPGTSPSGESSTAPGTSPSGESSTAPGSTSSTAESPGPGTSPSGESSTAPGTSPSGESSTAPGSTSSTAESPGPGTSTPESGSASPGTSTPESGSASPGSTSESPSGTAPGSTSESPSGTAPGTSTPESGSASPGSTSSTAESPGPGTSTPESGSASPGSTSESPSGTAPGTSPSGESSTAPGSTSSTAESPGPGTSPSGESSTAPGTSTPESGSASPGSTSSTAESPGPGSTSSTAESPGPGSTSSTAESPGPGSTSSTAESPGPGTSPSGESSTAPGSTSESPSGTAPGSTSESPSGTAPGTSTPESGPXXXGASASGAPSTXXXXSESPSGTAPGSTSESPSGTAPGSTSESPSGTAPGSTSESPSGTAPGSTSESPSGTAPGSTSESPSGTAPGTSTPESGSASPGTSPSGESSTAPGTSPSGESSTAPGSTSSTAESPGPGTSPSGESSTAPGTSTPESGSASPGSTSESPSGTAPGSTSESPSGTAPGTSPSGESSTAPGSTSESPSGTAPGTSTPESGSASPGTSTPESGSASPGSTSESPSGTAPGTSTPESGSASPGSTSSTAESPGPGSTSESPSGTAPGSTSESPSGTAPGTSPSGESSTAPGSTSSTAESPGPGTSPSGESSTAPGTSTPESGSASPGTSPSGESSTAPGTSPSGESSTAPGTSPSGESSTAPGSTSSTAESPGPGSTSSTAESPGPGTSPSGESSTAPGSSPSASTGTGPGSSTPSGATGSPGSSTPSGATGSPG

SEQ ID NO: 837 - protein, 1176 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSGTGSGEGSEGEGGGEGSEGEGSGEGGEGEGSGSGMEDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKG

SEQ ID NO: 838 - protein, 1127 aa, Artificial Sequence
  Description of Artificial Sequence: Synthetic polypeptide
MEDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGTGSGEGSEGEGGGEGSEGEGSGEGGEGEGSGSGQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSGGTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSAG

SEQ ID NO: 839 - protein, 1383 aa, Artificial Sequence
  Description of Artificial Sequence: Synthetic polypeptide
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGMEDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETAG

SEQ ID NO: 840 - protein, 551 aa, Artificial Sequence
  Description of Artificial Sequence: Synthetic polypeptide
MKDIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITRTGSGEGSEGEGGGEGSEGEGSGEGGEGEGSGTQVQLVQSGGGVVQPGRSLRLSCKASGYTFTRYTMHWVRQAPGKGLEWIGYINPSRGYTNYNQKFKDRFTISTDKSKSTAFLQMDSLRPEDTAVYYSARYYDDHYCLDYWGQGTPVTVSSGGEGSGEGSEGEGSEGSGEGEGSEGSGEGEGGSEGSEGEGGSEGSEGEGGSEGSEGEGSGEGSEGEGGSEGSEGEGSGEGSEGEGSEGGSEGEGGSEGSEGEGSGEGSEGEGGEGGSEGEGSEGSGEGEGSGEGSEGEGSEGSGEGEGSGEGSEGEGSEGSGEGEGSEGSGEGEGGSEGSEGEGSEGSGEGEGGEGSGEGEGSGEGSEGEGGGEGSEGEGSGEGGEGEGSEGGSEGEGGSEGGEGEGSEGSGEGEGSEGGSEGEGSEGGSEGEGSEGSGEGEGSEGSGEGS

SEQ ID NO: 841 - protein, 952 aa, Artificial Sequence
  Description of Artificial Sequence: Synthetic polypeptide
MKDIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITRGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGQVQLVQSGGGVVQPGRSLRLSCKASGYTFTRYTMHWVRQAPGKGLEWIGYINPSRGYTNYNQKFKDRFTISTDKSKSTAFLQMDSLRPEDTAVYYSARYYDDHYCLDYWGQGTPVTVSSGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPG

SEQ ID NO: 842 - protein, 1314 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGQVQLVQSGGGVVQPGRSLRLSCKASGYTFTRYTMHWVRQAPGKGLEWIGYINPSRGYTNYNQKFKDRFTISTDKSKSTAFLQMDSLRPEDTAVYYSARYYDDHYCLDYWGQGTPVTVSSGGAPSTGGTSESATPESGPGTSTEPSEGSAPGTSTEPSEGSAPGTSESATPESGPGTSTEPSEGSAPGTSTEPSEGSAPGTSESATPESGPGTSTEPSEGSAPGTSTEPSEGSAPGTSTEPSEGSAPGSPAGSPTSTEEGTSTEPSEGSAPGPEPTGPAGMKDIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITRG

SEQ ID NO: 843 - protein, 1149 aa, Artificial Sequence
  Description of Artificial Sequence: Synthetic polypeptide
MKDIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITRGGAPGTSESATPESGPGSEPATSGSETPGTSTEPSEGSAPGPAGQVQLVQSGGGVVQPGRSLRLSCKASGYTFTRYTMHWVRQAPGKGLEWIGYINPSRGYTNYNQKFKDRFTISTDKSKSTAFLQMDSLRPEDTAVYYSARYYDDHYCLDYWGQGTPVTVSSGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPG

SEQ ID NO: 844 - protein, 1289 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGMKDIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITRGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGQVQLVQSGGGVVQPGRSLRLSCKASGYTFTRYTMHWVRQAPGKGLEWIGYINPSRGYTNYNQKFKDRFTISTDKSKSTAFLQMDSLRPEDTAVYYSARYYDDHYCLDYWGQGTPVTVSSG

SEQ ID NO: 845 - protein, 1178 aa, Artificial Sequence
  Description of Artificial Sequence: Synthetic polypeptide
MAEPAGSPTSTEEGTPGSGTASSSPGSSTPSGATGSPGASPGTSSTGSPGQVQLVQSGGGVVQPGRSLRLSCKASGYTFTRYTMHWVRQAPGKGLEWIGYINPSRGYTNYNQKFKDRFTISTDKSKSTAFLQMDSLRPEDTAVYYSARYYDDHYCLDYWGQGTPVTVSSGTGSGEGSEGEGGGEGSEGEGSGEGGEGEGSGSGMKDIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITRGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 846 - protein, 1199 aa, Artificial Sequence
  Description of Artificial Sequence: Synthetic polypeptide
MAEPAGSPTSTEEGASPGTSSTGSPGSSTPSGATGSPGSSTPSGATGSPGMKDIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITRGGAPGTSESATPESGPGSEPATSGSETPGTSTEPSEGSAPGPAGQVQLVQSGGGVVQPGRSLRLSCKASGYTFTRYTMHWVRQAPGKGLEWIGYINPSRGYTNYNQKFKDRFTISTDKSKSTAFLQMDSLRPEDTAVYYSARYYDDHYCLDYWGQGTPVTVSSGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPG

SEQ ID NO: 847 - protein, 1154 aa, Artificial Sequence
  Description of Artificial Sequence: Synthetic polypeptide
EVQLQESGGGLVQAGDSLRLSCLVSGRSFNSYTMGWFRQAPGKEREFVAAILWSGPTTYYADSVKGRFTISRDNAKNTVYLQMNSLKPEDTAVYYCAAALGVLVLAPGNVYSYWGQGTQVTVSSAHHGTGSGEGSEGEGGGEGSEGEGSGEGGEGEGSGSGEVQLQESGGGLVQAGDSLRLSCLVSGRSFNSYTMGWFRQAPGKEREFVAAILWSGPTTYYADSVKGRFTISRDNAKNTVYLQMNSLKPEDTAVYYCAAALGVLVLAPGNVYSYWGQGTQVTVSSAHHGGTSTEPSEPGSAGTSTEPSEPGSAGSEPATSGTEPSGSGASEPTSTEPGSEPATSGTEPSGSEPATSGTEPSGSEPATSGTEPSGSGASEPTSTEPGTSTEPSEPGSAGSEPATSGTEPSGTSTEPSEPGSAGSEPATSGTEPSGSEPATSGTEPSGTSTEPSEPGSAGTSTEPSEPGSAGSEPATSGTEPSGSEPATSGTEPSGTSEPSTSEPGAGSGASEPTSTEPGTSEPSTSEPGAGSEPATSGTEPSGSEPATSGTEPSGTSTEPSEPGSAGTSTEPSEPGSAGSGASEPTSTEPGSEPATSGTEPSGSEPATSGTEPSGSEPATSGTEPSGSEPATSGTEPSGTSTEPSEPGSAGSEPATSGTEPSGSGASEPTSTEPGTSTEPSEPGSAGSEPATSGTEPSGSGASEPTSTEPGTSTEPSEPGSAGSGASEPTSTEPGSEPATSGTEPSGSGASEPTSTEPGSEPATSGTEPSGSGASEPTSTEPGTSTEPSEPGSAGSEPATSGTEPSGSGASEPTSTEPGTSTEPSEPGSAGSEPATSGTEPSGTSTEPSEPGSAGSEPATSGTEPSGTSTEPSEPGSAGTSTEPSEPGSAGTSTEPSEPGSAGTSTEPSEPGSAGTSTEPSEPGSAGTSTEPSEPGSAGTSEPSTSEPGAGSGASEPTSTEPGTSTEPSEPGSAGTSTEPSEPGSAGTSTEPSEPGSAGSEPATSGTEPSGSGASEPTSTEPGSEPATSGTEPSGSEPATSGTEPSGSEPATSGTEPSGSEPATSGTEPSGTSEPSTSEPGAGSEPATSGTEPSGSGASEPTSTEPGTSTEPSEPGSAGSEPATSGTEPSGSGASEPTSTEPGTSTEPSEPGSAG

SEQ ID NO: 848 - protein, 1266 aa, Artificial Sequence
  Description of Artificial Sequence: Synthetic polypeptide
EVQLQESGGGLVQAGDSLRLSCLVSGRSFNSYTMGWFRQAPGKEREFVAAILWSGPTTYYADSVKGRFTISRDNAKNTVYLQMNSLKPEDTAVYYCAAALGVLVLAPGNVYSYWGQGTQVTVSSAHHGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGEVQLQESGGGLVQAGDSLRLSCLVSGRSFNSYTMGWFRQAPGKEREFVAAILWSGPTTYYADSVKGRFTISRDNAKNTVYLQMNSLKPEDTAVYYCAAALGVLVLAPGNVYSYWGQGTQVTVSSAHHGGSETATSGSETAGTSESATSESGAGSTAGSETSTEAGTSESATSESGAGSETATSGSETAGSETATSGSETAGTSTEASEGSASGTSTEASEGSASGTSESATSESGAGSETATSGSETAGTSTEASEGSASGSTAGSETSTEAGTSESATSESGAGTSESATSESGAGSETATSGSETAGTSESATSESGAGTSTEASEGSASGSETATSGSETAGSETATSGSETAGTSTEASEGSASGSTAGSETSTEAGTSESATSESGAGTSTEASEGSASGSETATSGSETAGSTAGSETSTEAGSTAGSETSTEAGSETATSGSETAGTSESATSESGAGTSESATSESGAGSETATSGSETAGTSESATSESGAGTSESATSESGAGSETATSGSETAGSETATSGSETAGTSTEASEGSASGSTAGSETSTEAGSETATSGSETAGTSESATSESGAGSTAGSETSTEAGSTAGSETSTEAGSTAGSETSTEAGTSTEASEGSASGSTAGSETSTEAGSTAGSETSTEAGTSTEASEGSASGSTAGSETSTEAGSETATSGSETAGTSTEASEGSASGTSESATSESGAGSETATSGSETAGTSESATSESGAGTSESATSESGAGSETATSGSETAGTSESATSESGAGSETATSGSETAGTSTEASEGSASGTSTEASEGSASGSTAGSETSTEAGSTAGSETSTEAGSETATSGSETAGTSESATSESGAGTSESATSESGAGSETATSGSETAGSETATSGSETAGSETATSGSETAGTSTEASEGSASGTSESATSESGAGSETATSGSETAGSETATSGSETAGTSESATSESGAGTSESATSESGAGSETATSGSETAG

SEQ ID NO: 849 - protein, 978 aa, Artificial Sequence
  Description of Artificial Sequence: Synthetic polypeptide
EVQLQESGGGLVQAGDSLRLSCLVSGRSFNSYTMGWFRQAPGKEREFVAAILWSGPTTYYADSVKGRFTISRDNAKNTVYLQMNSLKPEDTAVYYCAAALGVLVLAPGNVYSYWGQGTQVTVSSAHHGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGEVQLQESGGGLVQAGDSLRLSCLVSGRSFNSYTMGWFRQAPGKEREFVAAILWSGPTTYYADSVKGRFTISRDNAKNTVYLQMNSLKPEDTAVYYCAAALGVLVLAPGNVYSYWGQGTQVTVSSAHHGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPG

SEQ ID NO: 850 - protein, 1175 aa, Artificial Sequence
  Description of Artificial Sequence: Synthetic polypeptide
EVQLQESGGGLVQAGDSLRLSCLVSGRSFNSYTMGWFRQAPGKEREFVAAILWSGPTTYYADSVKGRFTISRDNAKNTVYLQMNSLKPEDTAVYYCAAALGVLVLAPGNVYSYWGQGTQVTVSSAHHGGAPGTSESATPESGPGSEPATSGSETPGTSTEPSEGSAPGPAGEVQLQESGGGLVQAGDSLRLSCLVSGRSFNSYTMGWFRQAPGKEREFVAAILWSGPTTYYADSVKGRFTISRDNAKNTVYLQMNSLKPEDTAVYYCAAALGVLVLAPGNVYSYWGQGTQVTVSSAHHGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPG

SEQ ID NO: 851 - protein, 1734 aa, Artificial Sequence
  Description of Artificial Sequence: Synthetic polypeptide
EVQLQESGGGLVQAGDSLRLSCLVSGRSFNSYTMGWFRQAPGKEREFVAAILWSGPTTYYADSVKGRFTISRDNAKNTVYLQMNSLKPEDTAVYYCAAALGVLVLAPGNVYSYWGQGTQVTVSSAHHGGAPSTGGTSESATPESGPGTSTEPSEGSAPGTSTEPSEGSAPGTSESATPESGPGTSTEPSEGSAPGTSTEPSEGSAPGTSESATPESGPGTSTEPSEGSAPGTSTEPSEGSAPGTSTEPSEGSAPGSPAGSPTSTEEGTSTEPSEGSAPGPEPTGPAGEVQLQESGGGLVQAGDSLRLSCLVSGRSFNSYTMGWFRQAPGKEREFVAAILWSGPTTYYADSVKGRFTISRDNAKNTVYLQMNSLKPEDTAVYYCAAALGVLVLAPGNVYSYWGQGTQVTVSSAHHGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPG

SEQ ID NO: 852 - protein, 808 aa, Artificial Sequence
  Description of Artificial Sequence: Synthetic polypeptide
MEDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKTGSGEGSEGEGGGEGSEGEGSGEGGEGEGSGTEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSGGEGSGEGSEGEGSEGSGEGEGSEGSGEGEGGSEGSEGEGGSEGSEGEGGSEGSEGEGSGEGSEGEGGSEGSEGEGSGEGSEGEGSEGGSEGEGGSEGSEGEGSGEGSEGEGGEGGSEGEGSEGSGEGEGSGEGSEGEGSEGSGEGEGSGEGSEGEGSEGSGEGEGSEGSGEGEGGSEGSEGEGSEGSGEGEGGEGSGEGEGSGEGSEGEGGGEGSEGEGSGEGGEGEGSEGGSEGEGGSEGGEGEGSEGSGEGEGSEGGSEGEGSEGGSEGEGSEGSGEGEGSEGSGEGEDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKTGSGEGSEGEGGGEGSEGEGSGEGGEGEGSGTQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVS

SEQ ID NO: 853 - protein, 821 aa, Artificial Sequence
  Description of Artificial Sequence: Synthetic polypeptide
MEDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKTGSGEGSEGEGGGEGSEGEGSGEGGEGEGSGTEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSGSPGEGSGEGSEGEGSEGSGEGEGSEGSGEGEGGSEGSEGEGGSEGSEGEGGSEGSEGEGSGEGSEGEGGSEGSEGEGSGEGSEGEGSEGGSEGEGGSEGSEGEGSGEGSEGEGGEGGSEGEGSEGSGEGEGSGEGSEGEGSEGSGEGEGSGEGSEGEGSEGSGEGEGSEGSGEGEGGSEGSEGEGSEGSGEGEGGEGSGEGEGSGEGSEGEGGGEGSEGEGSGEGGEGEGSEGGSEGEGGSEGGEGEGSEGSGEGEGSEGGSEGEGSEGGSEGEGSEGSGEGEGSEGSGEGSSSLEGTKDIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITRTGSGEGSEGEGGGEGSEGEGSGEGGEGEGSGTQVQLVQSGGGVVQPGRSLRLSCKASGYTFTRYTMHWVRQAPGKGLEWIGYINPSRGYTNYNQKFKDRFTISTDKSKSTAFLQMDSLRPEDTAVYYSARYYDDHYCLDYWGQGTPVTVSSTSG

SEQ ID NO: 854 - protein, 1570 aa, Artificial Sequence
  Description of Artificial Sequence: Synthetic polypeptide
MKDIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITRGMAEPAGSPTSTEEGTPGSGTASSSPGSSTPSGATGSPGASPGTSSTGSPGQVQLVQSGGGVVQPGRSLRLSCKASGYTFTRYTMHWVRQAPGKGLEWIGYINPSRGYTNYNQKFKDRFTISTDKSKSTAFLQMDSLRPEDTAVYYSARYYDDHYCLDYWGQGTPVTVSSGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGMEDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGMAEPAGSPTSTEEGTPGSGTASSSPGSSTPSGATGSPGASPGTSSTGSPGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 855 - protein, 1570 aa, Artificial Sequence
  Description of Artificial Sequence: Synthetic polypeptide
QVQLVQSGGGVVQPGRSLRLSCKASGYTFTRYTMHWVRQAPGKGLEWIGYINPSRGYTNYNQKFKDRFTISTDKSKSTAFLQMDSLRPEDTAVYYSARYYDDHYCLDYWGQGTPVTVSSGMAEPAGSPTSTEEGTPGSGTASSSPGSSTPSGATGSPGASPGTSSTGSPGMKDIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITRGGSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAPGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSGMAEPAGSPTSTEEGTPGSGTASSSPGSSTPSGATGSPGASPGTSSTGSPGMEDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 856 - protein, 2024 aa, Artificial Sequence
  Description of Artificial Sequence: Synthetic polypeptide
MEDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGMAEPAGSPTSTEEGASPGTSSTGSPGSSTPSGATGSPGSSTPSGATGSPGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGMKDIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITRGMAEPAGSPTSTEEGASPGTSSTGSPGSSTPSGATGSPGSSTPSGATGSPGQVQLVQSGGGVVQPGRSLRLSCKASGYTFTRYTMHWVRQAPGKGLEWIGYINPSRGYTNYNQKFKDRFTISTDKSKSTAFLQMDSLRPEDTAVYYSARYYDDHYCLDYWGQGTPVTVSSGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGPEPTGPAPSGGSEPATSGSETPGTSESATPESGPGSPAGSPTSTEEGTSESATPESGPGSPAGSPTSTEEGSPAGSPTSTEEGTSESATPESGPGSPAGSPTSTEEGSPAGSPTSTEEGSTSSTAESPGPGSTSESPSGTAPGTSPSGESSTAPGSTSESPSGTAPGSTSESPSGTAPGTSPSGESSTAPGTSTEPSEGSAPGTSESATPESGPGTSESATPESGPGSEPATSGSETPGTSESATPESGPGTSESATPESGPGTSTEPSEGSAPGTSESATPESGPGTSTEPSEGSAPGTSPSGESSTAPGTSPSGESSTAPGTSPSGESSTAPGTSTEPSEGSAPGSPAGSPTSTEEGTSTEPSEGSAPGSSPSASTGTGPGSSTPSGATGSPGSSTPSGATGSPGSSTPSGATGSPGSSTPSGATGSPGASPGTSSTGSPGASASGAPSTGGTSPSGESSTAPGSTSSTAESPGPGTSPSGESSTAPGTSESATPESGPGTSTEPSEGSAPGTSTEPSEGSAPGSSPSASTGTGPGSSTPSGATGSPGASPGTSSTGSPGTSTPESGSASPGTSPSGESSTAPGTSPSGESSTAPGTSESATPESGPGSEPATSGSETPGTSTEPSEGSAPGSTSESPSGTAPGSTSESPSGTAPGTSTPESGSASPGSPAGSPTSTEEGTSESATPESGPGTSTEPSEGSAPGSPAGSPTSTEEGTSESATPESGPGSEPATSGSETPGSSTPSGATGSPGASPGTSSTGSPGSSTPSGATGSPGSTSESPSGTAPGTSPSGESSTAPGSTSSTAESPGPGSSTPSGATGSPGASPGTSSTGSPGTPGSGTASSSPGSPAGSPTSTEEGSPAGSPTSTEEGTSTEPSEGSAPG

SEQ ID NO: 857 - protein, 1581 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSGMAEPAGSPTSTEEGASPGTSSTGSPGSSTPSGATGSPGSSTPSGATGSPGMEDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGQVQLVQSGGGVVQPGRSLRLSCKASGYTFTRYTMHWVRQAPGKGLEWIGYINPSRGYTNYNQKFKDRFTISTDKSKSTAFLQMDSLRPEDTAVYYSARYYDDHYCLDYWGQGTPVTVSSGMAEPAGSPTSTEEGASPGTSSTGSPGSSTPSGATGSPGSSTPSGATGSPGMKDIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITRGGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPG

SEQ ID NO: 858 - protein, 1527 aa, Artificial Sequence
  Description of Artificial Sequence: Synthetic polypeptide
MEDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGAPGTSESATPESGPGSEPATSGSETPGTSTEPSEGSAPGPAGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGMEDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGAPSTGGTSESATPESGPGTSTEPSEGSAPGTSTEPSEGSAPGTSESATPESGPGTSTEPSEGSAPGTSTEPSEGSAPGTSESATPESGPGTSTEPSEGSAPGTSTEPSEGSAPGTSTEPSEGSAPGSPAGSPTSTEEGTSTEPSEGSAPGPEPTGPAGQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSGGSSESGSSEGGPGSGGEPSESGSSGSSESGSSEGGPGSSESGSSEGGPGSSESGSSEGGPGSSESGSSEGGPGSSESGSSEGGPGESPGGSSGSESGSEGSSGPGESSGSSESGSSEGGPGSSESGSSEGGPGSSESGSSEGGPGSGGEPSESGSSGESPGGSSGSESGESPGGSSGSESGSGGEPSESGSSGSSESGSSEGGPGSGGEPSESGSSGSGGEPSESGSSGSEGSSGPGESSGESPGGSSGSESGSGGEPSESGSSGSGGEPSESGSSGSGGEPSESGSSGSSESGSSEGGPGESPGGSSGSESGESPGGSSGSESGESPGGSSGSESGESPGGSSGSESGESPGGSSGSESGSSESGSSEGGPGSGGEPSESGSSGSEGSSGPGESSGSSESGSSEGGPGSGGEPSESGSSGSSESGSSEGGPGSGGEPSESGSSGESPGGSSGSESGESPGGSSGSESGSSESGSSEGGPGSGGEPSESGSSGSSESGSSEGGPGSGGEPSESGSSGSGGEPSESGSSGESPGGSSGSESGSEGSSGPGESSGSSESGSSEGGPGSEGSSGPGESSG

SEQ ID NO: 859 - protein, 1527 aa, Artificial Sequence
  Description of Artificial Sequence: Synthetic polypeptide
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSGGAPSTGGTSESATPESGPGTSTEPSEGSAPGTSTEPSEGSAPGTSESATPESGPGTSTEPSEGSAPGTSTEPSEGSAPGTSESATPESGPGTSTEPSEGSAPGTSTEPSEGSAPGTSTEPSEGSAPGSPAGSPTSTEEGTSTEPSEGSAPGPEPTGPAGMEDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSGGAPGTSESATPESGPGSEPATSGSETPGTSTEPSEGSAPGPAGMEDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPG

SEQ ID NO: 860 - protein, 1576 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGMEDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGAPGTSESATPESGPGSEPATSGSETPGTSTEPSEGSAPGPAGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGMEDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGAPSTGGTSESATPESGPGTSTEPSEGSAPGTSTEPSEGSAPGTSESATPESGPGTSTEPSEGSAPGTSTEPSEGSAPGTSESATPESGPGTSTEPSEGSAPGTSTEPSEGSAPGTSTEPSEGSAPGSPAGSPTSTEEGTSTEPSEGSAPGPEPTGPAGQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSG

SEQ ID NO: 861 - protein, 1864 aa, Artificial Sequence
  Description of Artificial Sequence: Synthetic polypeptide
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSGGAPSTGGTSESATPESGPGTSTEPSEGSAPGTSTEPSEGSAPGTSESATPESGPGTSTEPSEGSAPGTSTEPSEGSAPGTSESATPESGPGTSTEPSEGSAPGTSTEPSEGSAPGTSTEPSEGSAPGSPAGSPTSTEEGTSTEPSEGSAPGPEPTGPAGMEDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKGGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSGGAPGTSESATPESGPGSEPATSGSETPGTSTEPSEGSAPGPAGMEDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKG

SEQ ID NO: 862 - protein, 1847 aa, Artificial Sequence
  Description of Artificial Sequence: Synthetic polypeptide
MAEPAGSPTSTEEGASPGTSSTGSPGSSTPSGATGSPGSSTPSGATGSPGTSTEPSEGSAPGSEPATSGSETPGSPAGSPTSTEEGSTSSTAESPGPGTSTPESGSASPGSTSESPSGTAPGSTSESPSGTAPGTSTPESGSASPGTSTPESGSASPGSEPATSGSETPGTSESATPESGPGSPAGSPTSTEEGTSTEPSEGSAPGTSESATPESGPGTSTEPSEGSAPGTSTEPSEGSAPGSPAGSPTSTEEGTSTEPSEGSAPGTSTEPSEGSAPGTSESATPESGPGTSESATPESGPGTSTEPSEGSAPGTSTEPSEGSAPGTSESATPESGPGTSTEPSEGSAPGSEPATSGSETPGSPAGSPTSTEEGSSTPSGATGSPGTPGSGTASSSPGSSTPSGATGSPGTSTEPSEGSAPGTSTEPSEGSAPGSEPATSGSETPGSPAGSPTSTEEGSPAGSPTSTEEGTSTEPSEGSAPGASASGAPSTGGTSESATPESGPGSPAGSPTSTEEGSPAGSPTSTEEGSTSSTAESPGPGSTSESPSGTAPGTSPSGESSTAPGTPGSGTASSSPGSSTPSGATGSPGSSPSASTGTGPGSEPATSGSETPGTSESATPESGPGSEPATSGSETPGSTSSTAESPGPGSTSSTAESPGPGTSPSGESSTAPGSEPATSGSETPGSEPATSGSETPGTSTEPSEGSAPGSTSSTAESPGPGTSTPESGSASPGSTSESPSGTAPGTSTEPSEGSAPGTSTEPSEGSAPGTSTEPSEGSAPGSSTPSGATGSPGSSPSASTGTGPGASPGTSSTGSPGSEPATSGSETPGTSESATPESGPGSPAGSPTSTEEGSSTPSGATGSPGSSPSASTGTGPGASPGTSSTGSPGTSESATPESGPGTSTEPSEGSAPGTSTEPSEGSAPGMEDILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKGGAPSTGGTSESATPESGPGTSTEPSEGSAPGTSTEPSEGSAPGTSESATPESGPGTSTEPSEGSAPGTSTEPSEGSAPGTSESATPESGPGTSTEPSEGSAPGTSTEPSEGSAPGTSTEPSEGSAPGSPAGSPTSTEEGTSTEPSEGSAPGPEPTGPAGQVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSGGTSTPESGSASPGTSPSGESSTAPGTSPSGESSTAPGSTSSTAESPGPGSTSESPSGTAPGSTSSTAESPGPGTSPSGESSTAPGTSTPESGSASPGSTSSTAESPGPGTSPSGESSTAPGTSPSGESSTAPGTSPSGESSTAPGEVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSGGAPSTGGTSESATPESGPGTSTEPSEGSAPGTSTEPSEGSAPGTSESATPESGPGTSTEPSEGSAPGTSTEPSEGSAPGTSESATPESGPGTSTEPSEGSAPGTSTEPSEGSAPGTSTEPSEGSAPGSPAGSPTSTEEGTSTEPSEGSAPGPEPTGPAGMEDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKG

SEQ ID NO: 863 - DNA, 42 bp, Artificial Sequence
  Description of Artificial Sequence: Synthetic oligonucleotide
  CDS (1)..(39)
  modified_base (7)..(7): a, c, t, or g
  modified_base (9)..(9): a, c, t, or g
  modified_base (10)..(10): a, c, t, or g
  modified_base (12)..(12): a, c, t, or g
  see specification as filed for detailed description of substitutions and preferred embodiments
atggctnvnnvngctggctctccaacctccactgaggaaggt

SEQ ID NO: 864 - protein, 13 aa, Artificial Sequence
  Description of Artificial Sequence: Synthetic peptide
  misc_feature (3)..(3): The 'Xaa' at location 3 stands for Ala, Pro, Ser, Thr, Gly, or Glu.
  misc_feature (4)..(4): The 'Xaa' at location 4 stands for Ala, Pro, Ser, Thr, Gly, or Glu.
  see specification as filed for detailed description of substitutions and preferred embodiments
MAXXAGSPTSTEE

SEQ ID NO: 865 - DNA, 42 bp, Artificial Sequence
  Description of Artificial Sequence: Synthetic oligonucleotide
  CDS (1)..(39)
  modified_base (7)..(7): a, c, t, or g
  modified_base (9)..(9): a, c, t, or g
  modified_base (10)..(10): a, c, t, or g
  modified_base (12)..(12): a, c, t, or g
  see specification as filed for detailed description of substitutions and preferred embodiments
atggctnvnnvngaaagcgcaacccctgagtccggtccaggt

SEQ ID NO: 866 - protein, 13 aa, Artificial Sequence
  Description of Artificial Sequence: Synthetic peptide
  misc_feature (3)..(3): The 'Xaa' at location 3 stands for Ala, Pro, Ser, Thr, Gly, or Glu.
  misc_feature (4)..(4): The 'Xaa' at location 4 stands for Ala, Pro, Ser, Thr, Gly, or Glu.
  see specification as filed for detailed description of substitutions and preferred embodiments
MAXXESATPESGP

SEQ ID NO: 867 - DNA, 42 bp, Artificial Sequence
  Description of Artificial Sequence: Synthetic oligonucleotide
  CDS (1)..(39)
  modified_base (7)..(7): a, c, t, or g
  modified_base (9)..(9): a, c, t, or g
  modified_base (10)..(10): a, c, t, or g
  modified_base (12)..(12): a, c, t, or g
  see specification as filed for detailed description of substitutions and preferred embodiments
atggctnvnnvnactccgtctggtgctaccggttccccaggt

SEQ ID NO: 868 - protein, 13 aa, Artificial Sequence
  Description of Artificial Sequence: Synthetic peptide
  misc_feature (3)..(3): The 'Xaa' at location 3 stands for Ala, Pro, Ser, Thr, Gly, or Glu.
  misc_feature (4)..(4): The 'Xaa' at location 4 stands for Ala, Pro, Ser, Thr, Gly, or Glu.
  see specification as filed for detailed description of substitutions and preferred embodiments
MAXXTPSGATGSP

SEQ ID NO: 869 - protein, 11 aa, Artificial Sequence
  Description of Artificial Sequence: Synthetic peptide
ASTGETGETGE

SEQ ID NO: 870 - protein, 864 aa, Artificial Sequence; identical to SEQ ID NO: 61
  Description of Artificial Sequence: Synthetic polypeptide

SEQ ID NO: 871 - protein, 576 aa, Artificial Sequence; identical to SEQ ID NO: 56
  Description of Artificial Sequence: Synthetic polypeptide

SEQ ID NO: 872 - protein, 881 aa, Artificial Sequence
  Description of Artificial Sequence: Synthetic polypeptide
GASPGTSSTGSPGSSPSASTGTGPGSSPSASTGTGPGTPGSGTASSSPGSSTPSGATGSPGSSPSASTGTGPGASPGTSSTGSPGTPGSGTASSSPGSSTPSGATGSPGTPGSGTASSSPGASPGTSSTGSPGASPGTSSTGSPGTPGSGTASSSPGSSTPSGATGSPGASPGTSSTGSPGTPGSGTASSSPGSSTPSGATGSPGSSPSASTGTGPGSSPSASTGTGPGSSTPSGATGSPGSSTPSGATGSPGASPGTSSTGSPGASPGTSSTGSPGASPGTSSTGSPGTPGSGTASSSPGASPGTSSTGSPGASPGTSSTGSPGASPGTSSTGSPGSSPSASTGTGPGTPGSGTASSSPGASPGTSSTGSPGASPGTSSTGSPGASPGTSSTGSPGSSTPSGATGSPGSSTPSGATGSPGASPGTSSTGSPGTPGSGTASSSPGSSTPSGATGSPGSSTPSGATGSPGSSTPSGATGSPGSSPSASTGTGPGASPGTSSTGSPGASPGTSSTGSPGTPGSGTASSSPGASPGTSSTGSPGASPGTSSTGSPGASPGTSSTGSPGASPGTSSTGSPGTPGSGTASSSPGSSTPSGATGSPGTPGSGTASSSPGSSTPSGATGSPGTPGSGTASSSPGSSTPSGATGSPGSSTPSGATGSPGSSPSATASSSPGSSTPSGATGSSTGTGPGSSPSASTGTGPGASPGTSSTGSPGTPGSGTASSSPGSSTPSGATGSPGSSPSASTGTGPGSSPSASTGTGPGASPGTSSTGSPGASPGTSSTGSPGSSTPSGATGSPGSSPSASTGTGPGASPGTSSTGSPGSSPSASTGTGPGTPGSGTASSSPGSSTPSGATGSPGSSTPSGATGSPGASPGTSSTGSP

SEQ ID NO: 873 - protein, 316 aa, Artificial Sequence; identical to SEQ ID NO: 48
  Description of Artificial Sequence: Synthetic polypeptide

SEQ ID NO: 874 - protein, 864 aa, Artificial Sequence; identical to SEQ ID NO: 61
  Description of Artificial Sequence: Synthetic polypeptide

SEQ ID NO: 875 - protein, 144 aa, Artificial Sequence; identical to SEQ ID NO: 43
  Description of Artificial Sequence: Synthetic polypeptide

SEQ ID NO: 876 - protein, 864 aa, Artificial Sequence; identical to SEQ ID NO: 59
  Description of Artificial Sequence: Synthetic polypeptide

SEQ ID NO: 877 - protein, 576 aa, Artificial Sequence; identical to SEQ ID NO: 54
  Description of Artificial Sequence: Synthetic polypeptide

SEQ ID NO: 878 - protein, 864 aa, Artificial Sequence; identical to SEQ ID NO: 59
  Description of Artificial Sequence: Synthetic polypeptide

SEQ ID NO: 879 - protein, 288 aa, Artificial Sequence; identical to SEQ ID NO: 47
  Description of Artificial Sequence: Synthetic polypeptide

SEQ ID NO: 880 - protein, 4 aa, Artificial Sequence
  Description of Artificial Sequence: Synthetic peptide
IDGR

What is claimed is:

1. An isolated binding fusion protein comprising a first targeting moiety with specific binding affinity to a first target and a first extended recombinant polypeptide (XTEN) wherein the fusion protein comprises a sequence which is at least 90% identical to a sequence selected from the group consisting of SEQ ID NOS: 723, 724, 725, 726, 727, 728, 729, 730, 731, 732, 733, 734, 735, 736, 738, 744, 746, 747, 802, 803, 804, 805, 806, 807, 808, 809, 810, 811, 812, 814, 815, 816, 817, 818, 819, 820, 821, 823, 824, 825, 826, 827, 828, 829, 830, 831, 832, 835, 837, 839, 841, 842, 843, 844, 845, 846, 848, 849, 850, and 851.

2. The isolated binding fusion protein of claim 1, wherein the first targeting moiety binds to the target with a dissociation constant of less than $10^{-7}$ M.

3. An isolated binding fusion protein comprising a first targeting moiety with specific binding affinity to a first target, a second targeting moiety with specific binding to a second target, and a first extended recombinant polypeptide (XTEN) wherein the fusion protein comprises a sequence which is at least 90% identical to a sequence selected from the group consisting of SEQ ID NOS: 854, 855, 856, 857, 858, 859, 860, 861, and 862.

4. The isolated binding fusion protein of claim 3, wherein the first targeting moiety binds to the target with a dissociation constant of less than $10^{-7}$ M and the second targeting moiety has binding affinity with a dissociation constant of less than $10^{-7}$ M to said second target.

5. The binding fusion protein of claim 1 or 3, further comprising a second XTEN wherein the second XTEN exhibits at least 90% sequence identity compared to a sequence selected from the group consisting of SEQ ID NO:41, SEQ ID NO:47, SEQ ID NO:54, and SEQ ID NO:59, when optimally aligned and wherein the cumulative total of XTEN amino acid residues is at least 400 amino acid residues.

6. The isolated fusion protein of claim 5 that is configured according to formula I:

$$(XTEN)\text{-}TM\text{-}(XTEN) \qquad I$$

wherein TM is a targeting moiety between two XTENs.

7. The isolated binding fusion protein of any one of claim 1, 3, or 4, wherein the binding fusion protein has an apparent molecular weight factor of at least 5.

8. The isolated binding fusion protein of any one of claim 1, 3, or 4, further comprising one or more molecules of a drug selected from the group consisting of duocarmycin, calicheamycin, maytansine, monomethylauristatin E, and paclitaxel covalently attached by a cross-linker to the XTEN.

9. A pharmaceutical composition comprising the binding fusion protein of any one of claim 1, 3, or 4, and at least one pharmaceutically acceptable carrier.

10. An isolated nucleic acid comprising a polynucleotide sequence selected from (a) a polynucleotide encoding the binding fusion protein of any one of claim 1, 2, or 3, or (b) the complement of the polynucleotide of (a).

11. An expression vector comprising the polynucleotide sequence of claim 10 and a recombinant regulatory sequence operably linked to the polynucleotide sequence.

12. The isolated binding fusion protein of claim 8, wherein the cross-linker is selected from the group consisting of imidoesters, active halogens, maleimide, pyridyl disulfide, and NHS-esters.

13. The isolated binding fusion protein of claim 5, further comprising one or more molecules of a drug selected from the group consisting of duocarmycin, calicheamycin, maytansine, monomethylauristatin E, and paclitaxel covalently attached by a cross-linker to the XTEN.

14. The isolated binding fusion protein of claim 1, wherein the first targeting moiety exhibits specific binding affinity to Her2.

15. The isolated binding fusion protein of claim 1, wherein the first targeting moiety exhibits specific binding affinity to EGFR.

16. The isolated binding fusion protein of claim 1, wherein the first targeting moiety exhibits specific binding affinity to CD3.

17. The isolated binding fusion protein of claim 1, wherein the first targeting moiety exhibits specific binding affinity to CTLA4.

18. The isolated binding fusion protein of claim 1, wherein the first targeting moiety exhibits specific binding affinity to IL6R.

19. The isolated binding fusion protein of claim 1, wherein the first targeting moiety exhibits specific binding affinity to CD40.

* * * * *